(12) United States Patent
Harrington et al.

(10) Patent No.: US 11,174,470 B2
(45) Date of Patent: Nov. 16, 2021

(54) PROGRAMMABLE NUCLEASE IMPROVEMENTS AND COMPOSITIONS AND METHODS FOR NUCLEIC ACID AMPLIFICATION AND DETECTION

(71) Applicant: MAMMOTH BIOSCIENCES, INC., South San Francisco, CA (US)

(72) Inventors: Lucas Benjamin Harrington, Berkeley, CA (US); Janice Sha Chen, San Francisco, CA (US); James Paul Broughton, San Francisco, CA (US); Pedro Patrick Draper Galarza, Oakland, CA (US); Wiputra J. Hartono, San Francisco, CA (US); Isaac Paterson Witte, Walnut Creek, CA (US); Jasmeet Singh, Santa Clara, CA (US)

(73) Assignee: MAMMOTH BIOSCIENCES, INC., South San Francisco, CA (US)

( * ) Notice: Subject to any disclaimer, the term of this patent is extended or adjusted under 35 U.S.C. 154(b) by 0 days.

(21) Appl. No.: 17/037,620

(22) Filed: Sep. 29, 2020

(65) Prior Publication Data
US 2021/0009974 A1     Jan. 14, 2021

Related U.S. Application Data

(63) Continuation of application No. PCT/US2020/012276, filed on Jan. 3, 2020.

(60) Provisional application No. 62/788,706, filed on Jan. 4, 2019, provisional application No. 62/894,515, filed on Aug. 30, 2019, provisional application No. 62/944,939, filed on Dec. 6, 2019, provisional application No. 62/788,704, filed on Jan. 4, 2019, provisional application No. 62/795,463, filed on Jan. 22, 2019, provisional application No. 62/863,166, filed on Jun. 18, 2019, provisional application No. 62/881,801, filed on Aug. 1, 2019, provisional application No. 62/944,933, filed on Dec. 6, 2019.

(51) Int. Cl.
| | |
|---|---|
| *C12N 9/22* | (2006.01) |
| *C12N 15/113* | (2010.01) |
| *C12Q 1/6886* | (2018.01) |
| *C12Q 1/70* | (2006.01) |

(52) U.S. Cl.
CPC .............. *C12N 9/22* (2013.01); *C12N 15/113* (2013.01); *C12Q 1/6886* (2013.01); *C12Q 1/701* (2013.01); *C12N 2310/20* (2017.05); *C12N 2800/80* (2013.01); *C12Q 2600/156* (2013.01)

(58) Field of Classification Search
CPC ....... C12N 15/11; C12N 9/22; C12N 2310/20
See application file for complete search history.

(56) References Cited

U.S. PATENT DOCUMENTS

| | | |
|---|---|---|
| 3,687,808 A | 8/1972 | Merigan, Jr. et al. |
| 5,034,506 A | 7/1991 | Summerton et al. |
| 5,489,677 A | 2/1996 | Sanghvi et al. |
| 5,539,082 A | 7/1996 | Nielsen et al. |
| 5,602,240 A | 2/1997 | De Mesmaeker et al. |
| 5,714,331 A | 2/1998 | Buchardt et al. |
| 5,719,262 A | 2/1998 | Buchardt et al. |
| 6,312,928 B1 | 11/2001 | Van Gemen et al. |
| 6,773,885 B1 | 8/2004 | Walder et al. |
| 8,030,000 B2 | 10/2011 | Piepenburg et al. |
| 8,426,134 B2 | 4/2013 | Piepenburg et al. |
| 8,586,718 B2 | 11/2013 | Benson et al. |
| 8,597,886 B2 | 12/2013 | Smith et al. |
| 8,815,782 B2 | 8/2014 | Zeiner et al. |
| 8,822,673 B2 | 9/2014 | Chou et al. |
| 8,945,845 B2 | 2/2015 | Piepenburg et al. |
| 9,309,502 B2 | 4/2016 | Piepenburg et al. |
| 9,663,820 B2 | 5/2017 | Piepenburg et al. |
| 9,730,967 B2 | 8/2017 | Kovarik et al. |
| 9,790,490 B2 | 10/2017 | Zhang et al. |
| 10,113,179 B2 | 10/2018 | Begemann et al. |
| 10,253,365 B1 | 4/2019 | Doudna et al. |

(Continued)

FOREIGN PATENT DOCUMENTS

| | | |
|---|---|---|
| CN | 106701830 A | 5/2017 |
| CN | 107488710 A | 12/2017 |

(Continued)

OTHER PUBLICATIONS

Chen et al.; CRISPR-Cas12a target binding unleashes indiscriminate single-stranded DNase activity; Science 360, 436-439, published online Feb. 15, 2018, and supplemental material (Year: 2018).*

(Continued)

*Primary Examiner* — Antonio Galisteo Gonzalez
(74) *Attorney, Agent, or Firm* — Wilson Sonsini Goodrich & Rosati

(57) ABSTRACT

Disclosed herein are compositions, kits, and methods related to improved Cas activity. Through compositions and kits disclosed herein and practice of methods disclosed herein, one attains improved Cas activity such as Cas12 activity relative to Cas proteins in the art such as LbCas12. Further described herein are methods to detect target nucleic acid using a programmable nuclease system. Often, the target nucleic acids are present in at low frequency in the sample. Provided herein are methods for enriching these target nucleic acids for detection. Also described herein are methods to insert a PAM sequence into a target sequence of interest for use in a detection comprising a programmable nuclease.

26 Claims, 107 Drawing Sheets

Specification includes a Sequence Listing.

(56) References Cited

U.S. PATENT DOCUMENTS

| | | |
|---|---|---|
| 10,266,886 B2 | 4/2019 | Abudayyeh et al. |
| 10,266,887 B2 | 4/2019 | Abudayyeh et al. |
| 10,316,324 B2 | 6/2019 | Begemann et al. |
| 10,337,051 B2 | 7/2019 | Doudna et al. |
| 10,494,664 B2 | 12/2019 | Doudna et al. |
| 10,570,415 B2 | 2/2020 | Doudna et al. |
| 10,648,020 B2 | 5/2020 | Zhang et al. |
| 2003/0003486 A1 | 1/2003 | Sauer et al. |
| 2006/0179585 A1 | 8/2006 | Zilles et al. |
| 2011/0172420 A1 | 7/2011 | Zilles et al. |
| 2011/0190486 A1 | 8/2011 | Zilles et al. |
| 2011/0223677 A1 | 9/2011 | Arden-Jacob et al. |
| 2011/0293703 A1 | 12/2011 | Mahon et al. |
| 2013/0224871 A1 | 8/2013 | Zilles et al. |
| 2013/0261196 A1 | 10/2013 | Diamond et al. |
| 2013/0323851 A1 | 12/2013 | Arden-Jacob et al. |
| 2014/0068797 A1 | 3/2014 | Doudna et al. |
| 2014/0093883 A1 | 4/2014 | Maples et al. |
| 2014/0194611 A1 | 7/2014 | Cook et al. |
| 2014/0273226 A1 | 9/2014 | Wu |
| 2014/0349295 A1 | 11/2014 | Hosaka et al. |
| 2014/0378330 A1 | 12/2014 | Petrauskene et al. |
| 2015/0211058 A1 | 7/2015 | Carstens |
| 2015/0325006 A1 | 11/2015 | Adiri et al. |
| 2016/0138008 A1 | 5/2016 | Doudna et al. |
| 2016/0208243 A1 | 7/2016 | Zhang et al. |
| 2017/0037432 A1 | 2/2017 | Donohoue et al. |
| 2017/0051276 A1 | 2/2017 | May et al. |
| 2017/0175104 A1 | 6/2017 | Doudna et al. |
| 2017/0198277 A1 | 7/2017 | Kmiec et al. |
| 2017/0211142 A1 | 7/2017 | Smargon et al. |
| 2017/0233756 A1 | 8/2017 | Begemann et al. |
| 2017/0306335 A1 | 10/2017 | Zhang et al. |
| 2017/0321198 A1 | 11/2017 | Severinov et al. |
| 2017/0321214 A1 | 11/2017 | Zhang et al. |
| 2017/0349913 A1 | 12/2017 | Chen |
| 2018/0155716 A1 | 6/2018 | Zhang et al. |
| 2018/0179503 A1 | 6/2018 | Maianti et al. |
| 2018/0208976 A1 | 7/2018 | Doudna et al. |
| 2018/0208977 A1 | 7/2018 | Doudna et al. |
| 2018/0274017 A1 | 9/2018 | Abudayyeh et al. |
| 2018/0282713 A1 | 10/2018 | Van Der Oost |
| 2018/0298445 A1 | 10/2018 | Abudayyeh et al. |
| 2018/0305704 A1 | 10/2018 | Zhang |
| 2018/0320163 A1 | 11/2018 | Koonin et al. |
| 2018/0327786 A1 | 11/2018 | Severinov et al. |
| 2018/0340218 A1 | 11/2018 | Abudayyeh et al. |
| 2018/0362943 A1 | 12/2018 | Chittoor et al. |
| 2019/0010481 A1 | 1/2019 | Joung et al. |
| 2019/0070610 A1 | 3/2019 | Haworth et al. |
| 2019/0071717 A1 | 3/2019 | Zhang et al. |
| 2019/0083656 A1 | 3/2019 | Khalili et al. |
| 2019/0093107 A1 | 3/2019 | Zhang et al. |
| 2019/0144929 A1 | 5/2019 | Abudayyeh et al. |
| 2019/0177775 A1 | 6/2019 | Doudna et al. |
| 2019/0202856 A1 | 7/2019 | Davis et al. |
| 2019/0218602 A1 | 7/2019 | Zhang et al. |
| 2019/0241954 A1 | 8/2019 | Doudna et al. |
| 2019/0256900 A1 | 8/2019 | Zhang et al. |
| 2019/0264186 A1 | 8/2019 | Yamano et al. |
| 2019/0276842 A1 | 9/2019 | Doudna et al. |
| 2019/0300908 A1 | 10/2019 | Doudna et al. |
| 2019/0309357 A1 | 10/2019 | Abudayyeh et al. |
| 2020/0010817 A1 | 1/2020 | Van Der Oost |
| 2020/0010878 A1 | 1/2020 | Doudna et al. |
| 2020/0010879 A1 | 1/2020 | Doudna et al. |
| 2020/0017879 A1 | 1/2020 | Doudna et al. |
| 2020/0032242 A1 | 1/2020 | Schneider |
| 2020/0087640 A1 | 3/2020 | Doudna et al. |
| 2020/0181720 A1 | 6/2020 | Abudayyeh et al. |
| 2020/0238274 A1 | 7/2020 | Breidenbach et al. |
| 2020/0254443 A1 | 8/2020 | Zhang et al. |
| 2020/0277600 A1 | 9/2020 | Zhang et al. |
| 2020/0299768 A1 | 9/2020 | Doudna et al. |
| 2020/0392473 A1 | 12/2020 | Zhang et al. |

FOREIGN PATENT DOCUMENTS

| | | |
|---|---|---|
| EP | 2825654 A1 | 1/2015 |
| EP | 3009511 A2 | 4/2016 |
| EP | 3251332 A1 | 12/2017 |
| EP | 3252160 A1 | 12/2017 |
| EP | 3283625 A1 | 2/2018 |
| EP | 3310917 A1 | 4/2018 |
| EP | 3430134 A1 | 1/2019 |
| EP | 3436575 A1 | 2/2019 |
| EP | 3445848 A1 | 2/2019 |
| EP | 3455357 A1 | 3/2019 |
| EP | 3470519 A1 | 4/2019 |
| EP | 3500967 A1 | 6/2019 |
| EP | 3502253 A1 | 6/2019 |
| EP | 3546573 A1 | 10/2019 |
| EP | 3551753 A1 | 10/2019 |
| EP | 3596218 A1 | 1/2020 |
| EP | 3604532 A1 | 2/2020 |
| EP | 3653722 A1 | 5/2020 |
| JP | 2004521606 A | 7/2004 |
| JP | 6495395 B2 | 4/2019 |
| KR | 101897213 B1 | 9/2018 |
| WO | WO-9839352 A1 | 9/1998 |
| WO | WO-9914226 A2 | 3/1999 |
| WO | WO-0142505 A2 | 6/2001 |
| WO | WO-0186001 A1 | 11/2001 |
| WO | WO-2014118272 A1 | 8/2014 |
| WO | WO-2015071474 A2 | 5/2015 |
| WO | WO-2015191693 A2 | 12/2015 |
| WO | WO-2016028843 A2 | 2/2016 |
| WO | WO-2016094867 A1 | 6/2016 |
| WO | WO-2016094872 A1 | 6/2016 |
| WO | WO-2016106236 A1 | 6/2016 |
| WO | WO-2016123243 A1 | 8/2016 |
| WO | WO-2016205613 A1 | 12/2016 |
| WO | WO-2016205711 A | 12/2016 |
| WO | WO-2016205749 A1 | 12/2016 |
| WO | WO-2016205764 A1 | 12/2016 |
| WO | WO-2017070605 A1 | 4/2017 |
| WO | WO-2017120410 A1 | 7/2017 |
| WO | WO-2017147345 A1 | 8/2017 |
| WO | WO-2017176529 A1 | 10/2017 |
| WO | WO-2017184768 A1 | 10/2017 |
| WO | WO-2017184786 A1 | 10/2017 |
| WO | WO-2017189308 A1 | 11/2017 |
| WO | WO-2017205668 A1 | 11/2017 |
| WO | WO-2017209809 A1 | 12/2017 |
| WO | WO-2017218185 A1 | 12/2017 |
| WO | WO-2017218573 A1 | 12/2017 |
| WO | WO-2017219027 A1 | 12/2017 |
| WO | WO-2017223538 A1 | 12/2017 |
| WO | WO-2018064352 A1 | 4/2018 |
| WO | WO-2018064371 A1 | 4/2018 |
| WO | WO-2018107129 A1 | 6/2018 |
| WO | WO-2018170333 A1 | 9/2018 |
| WO | WO-2018170340 A1 | 9/2018 |
| WO | WO-2018195545 A2 | 10/2018 |
| WO | WO-2019005853 A2 | 1/2019 |
| WO | WO-2019005856 A1 | 1/2019 |
| WO | WO-2019011022 A1 | 1/2019 |
| WO | WO-2019051318 A1 | 3/2019 |
| WO | WO-2019071051 A1 | 4/2019 |
| WO | WO-2019079787 A1 | 4/2019 |
| WO | WO-2019089796 A1 | 5/2019 |
| WO | WO-2019089804 A1 | 5/2019 |
| WO | WO-2019089808 A1 | 5/2019 |
| WO | WO-2019089820 A1 | 5/2019 |
| WO | WO-2019104058 A1 | 5/2019 |
| WO | WO-2019126577 A2 | 6/2019 |
| WO | WO-2019126774 A1 | 6/2019 |
| WO | WO-2019148206 A1 | 8/2019 |
| WO | WO-2020028729 A1 | 2/2020 |
| WO | WO-2020142754 A2 | 7/2020 |

(56) References Cited

FOREIGN PATENT DOCUMENTS

| WO | WO-2020142754 A3 | 9/2020 |
|---|---|---|
| WO | WO-2020257356 A2 | 12/2020 |

OTHER PUBLICATIONS

Abraham et al.: Fluorescent Protein Based FRET Pairs with Improved Dynamic Range for Fluorescence Lifetime Measurements. PLoS One. 10(8): e0134436, 15 pages total (2015).

Abudayyeh, et al. C2c2 is a single-component programmable RNA-guided RNA-targeting CRISPR effector. Science. 353.6299 (Aug. 5, 2016).

Abudayyeh, et al.; "C2c2 is a single-component programmable RNA-guided RNA-targeting CRISPR effector; Supplementary Information"; Science; vol. 353, vol. 6299, 31 pages (Aug. 5, 2016).

Abudayyeh, et al. RNA targeting with CRISPR-Cas13. Nature, 550, (Oct. 12, 2017): 18 pages.

Ackerman et al.: 5—Comprehensive and Multiplexed Nucleic Acid Detection with Cas13. Session S330—CRISPR Tools. Itinerary. Abstract (2020).

Ackerman et al.: Massively multiplexed nucleic acid detection with Cas13. Nature. 582(7811): 277-282 (2020).

Alhasan et al.: Exosome encased spherical nucleic acid gold nanoparticle conjugates as potent microRNA regulation agents. Small. 10(1): 186-192 (2014).

Altschul, et al. Basic local alignment search tool. J Mol Biol. Oct. 5, 1990;215(3):403-10.

Ambion; "RnaseAlert Lab Test Kit v2, User Guide"; 12 pages (Mar. 1, 2013).

Anantharaman et al. (2016) Thousands of microbial genomes shed light on interconnected biogeochemical processes in anaquifer system. Nature Communications, 7:13219, pp. 1-11 (Year: 2016).

Applied Biosystems/Ambion; "RNaseAlert Lab Test Kit"; 12 pages (2008).

Armitage, et al. Hairpin-Fornning Peptide Nucleic Acid Oligomers. Biochemistry, 37 (1998): 9417-9425.

BAJAR er al.: A Guide to Fluorescent Protein FRET Pairs. Sensors (Basel). 16(9): 1488, 24 pages total (2016).

Baker, et al.; "Enigmatic, ultrasmall,uncultivated Archaea"; PNAS; vol. 107, No. 19, pp. 8806-8811 (May 11, 2010).

Baksh et al.: Detection of molecular interactions at membrane surfaces through colloid phase transitions. Nature.427(6970): 139-141 (2004).

Ball et al.: Quenching of Unincorporated Amplification Signal Reporters in Reverse-Transcription Loop-Mediated Isothermal Amplification Enabling Bright, Single-Step, Closed-Tube, and Multiplexed Detection of RNA Viruses. Anal Chem. 88(7): 3562-3568 (2016).

Bao et al.: Fluorescent probes for live-cell RNA detection. Annu Rev Biomed Eng. 11: 25-47 (2009).

Barrangou, et al. Expanding the CRISPR Toolbox: Targeting RNA with Cas13b. Molecular Cell. 65.4 (Feb. 16, 2017): 582-584.

Bautista, et al.; "Virus-Induced Dormancyin the Archaeon Sulfolobusislandicus"; mBio; vol. 6, No. 2, 8 pages (2015).

Braasch et al., Novel Antisense and Peptide Nucleic Acid Strategies for Controlling Gene Expression, Biochemistry, 41(14):4503-4509, 2002.

Burnstein et al.: New CRISPR-Cas systems from uncultivated microbes. Nature 542(7640): 237-241 (2017).

Bustin. Quantification of mRNA using real-time reverse transcription PCR (RT-PCR): trends and problems. J Mol Endocrinol 29(1):23-39 (2002).

Chen, et al. CRISPR-Cas12a target binding unleashes indiscriminate single-stranded DNase activity. Science. Apr. 27, 2018;360(6387):436-439. doi: 10.1126/science.aar6245. Epub Feb. 15, 2018.

Chen, et al. CRISPR-Cas12a target binding unleashes single-stranded DNase activity. Nov. 29, 2017. bioRxiv 226993; doi: https://doi.org/10.1101/226993.

Chen et al.: Enhanced proofreading governs CRISPR-Cas9 targeting accuracy. Nature 550(7676): 407-410 (2017).

Chen et al.: Molecular basis for the PAM expansion and fidelity enhancement of an evolved Cas9 nuclease. PLOS Biology 17(10): e3000496 (2019).

Choi et al.: Mechanism for the endocytosis of spherical nucleic acid nanoparticle conjugates. Proc Natl Acad Sci U S A.110(19): 7625-7630 (2013).

Choudhury et al.: CRISPR-dCas9 mediated TET1 targeting for selective DNA demethylation at BRCA1 promoter. Oncotarget 7(29): 46545-46556 (2016).

Chylinski et al. Classification and evolution of type II CRISPR-Cas Systems. Nucleic Acids Res 42(10):6091-6105 (2014).

Cong et al. Multiplex genome engineering using CRISPR/Cas systems. Science 339(6121):819-23 (2013).

Co-pending U.S. Appl. No. 16/927,351, inventors Doudna; Jennifer A. et al., filed Jul. 13, 2020.

Co-pending U.S. Appl. No. 17/037,592, inventors Chen; Janice Sha et al., filed Sep. 29, 2020.

Co-pending U.S. Appl. No. 17/037,594, inventors Chen; Janice Sha et al., filed Sep. 29, 2020.

Co-pending U.S. Appl. No. 17/039,865, inventors Chen; Janice Sha et al., filed Sep. 30, 2020.

Co-pending U.S. Appl. No. 17/039,928, inventors Chen; Janice Sha et al., filed Sep. 30, 2020.

Cox, et al. RNA editing with CRISPR-Cas13. Science, 358.6366 (Nov. 24, 2017): 15 pages.

Craw et al.: Isothermal nucleic acid amplification technologies for point-of-care diagnostics: a critical review. Lab Chip.12(14): 2469-2486 (2012).

Cutler et al.: Polyvalent nucleic acid nanostructures. J Am Chem Soc. 133(24): 9254-9257 (2011).

Cutler et al.: Spherical nucleic acids. J Am Chem Soc. 134(3): 1376-1391 (2012).

Deltcheva et al. CRISPR RNA maturation by trans-encoded small RNA and host factor RNase III. Nature 471:602-607 (2011).

East-Seletsky, et al. RNA Targeting by Functionally Orthogonal Type VI-A CRISPR-Cas Enzymes. Molecular Cell. 66 (May 4, 2017): 373-383.

East-Seletsky, et al. Two distinct Rnase activities of CRISPR-C2c2 enable guide-RNA processing and RNA detection. Nature. 538. 7624 (Oct. 13, 2016): 270-273.

European Patent Application No. 17813959 European Search Opinion and Extended European Search Report dated Jun. 12, 2019.

Fonfara et al. Phylogeny of Cas9 determines functional exchangeability of dual-RNA and Cas9 among orthologous type II CRISPR-Cas systems. Nucleic Acids Res 42(4):2577-2590 (2013) .

Gale et al.: A Review of Current Methods in Microfluidic Device Fabrication and Future Commercialization Prospects.Inventions 3(60): 1-25 (2018).

Gao et al.: Engineered Cpf1 variants with altered PAM specificities. Nature Biotechnology 35(8): 789-792 (2017).

GenBank CRZ35554 1; "Hypothetical protein HHT355_2368 [Herbinix hemicellulosilytica]"; 1 page (Oct. 11, 2018).

Gill, et al. Nucleic acid isothermal amplification technologies: a review. Nucleosides Nucleotides Nucleic Acids. Mar. 2008;27(3):224-43. doi: 10.1080/15257770701845204.

Gootenberg, et al. Multiplexed and portable nucleic acid detection platform with Cas13, Cas12a, and Csm6. Science. Apr. 27, 2018;360(6387):439-444. doi: 10.1126/science.aaq0179. Epub Feb. 15, 2018.

Gootenberg, et al. Nucleic acid detection with CRISPR-Cas13a/C2c2. Science, (Apr. 13, 2017): 9 pages.

Gu et al., Depletion of abundant sequences by hybridization (DASH): using Cas9 to remove unwanted high-abundance species in sequencing libraries and molecular counting applications. Genome Biology, 17:41, 13 pages, 2016.

Hale, et al. RNA-guided RNA cleavage by a CRISPR RNA-Cas protein complex. Cell. Nov. 25, 2009;139(5):945-56. doi: 10.1016/j.cell.2009.07.040.

Hale, et al. Target RNA capture and cleavage by the Cmr type III-B CRISPR-Cas effector complex. Genes & Development. 28.21 (Nov. 1, 2014): 2432-2443.

(56) References Cited

OTHER PUBLICATIONS

Hao et al.: Nucleic acid-gold nanoparticle conjugates as mimics of microRNA. Small. 7(22): 3158-3162 (2011).
Harrington et al.: Programmed DNA destruction by miniature CRISPR-Cas14 enzymes. Science. 362(6416): 839-842 (2018).
Hendel, et al. Chemically modified guide RNAs enhance CRISPR-Cas genome editing in human primary cells. Nat Biotechnol. Sep. 2015;33(9):985-9. doi: 10.1038/nbt.3290. Epub Jun. 29, 2015.
Hooton et al.: The Bacteriophage Carrier State of Campylobacter jejuni Features Changes in Host Non-coding RNAs and the Acquisition of New Host-derived CRISPR Spacer Sequences. Frontiers in Microbiology 7(355): 1-8(2016).
Hui Yang and Dinshaw J. Patel: "New CRISPR-Cas systemsdiscovered", Cell Research—Xibao Yanjiu, vol. 27, No. 3, Feb. 21, 2017, pp. 313-314.
Jacobsen et al.: The *Acidaminococcus* sp. Cas12a nuclease recognizes GTTV and GCTV as non-canonical PAMs. FEMS Microbiology Letters 366(8): 7 pages (2019).
Jensen et al.: Spherical nucleic acid nanoparticle conjugates as an RNAi-based therapy for glioblastoma. Sci Transl Med. 5(209): 209ra152, 22 pages total (2013).
Karvelis et al.: (2020) PAM recognition by miniature CRISPR-Cas12f nucleases triggers programmable double-stranded DNA target cleavage. Nucleic Acids Research, gkaa208: pp. 1-8 (Year: 2020).
Karvelis et al.: PAM recognition by miniature CRISPR-Cas14 triggers programmable double-stranded DNA target cleavage. Nucleic Acids Research, doi: 10.1093/nar/gkaa208: 10 pages (2020).
Kelemen, et al. Hypersensitive substrate for ribonucleases. Nucleic Acids Research, 27.18 (1999): 3696-3701.
Kim, et al.; "Specific and sensitive detection of nucleic acids and RNases using gold nanoparticle-RNA-fluorescent dye conjugates"; Chemical Communications; vol. 14, No. 42, pp. 4342-4344 (Sep. 19, 2007).
Kleinstiver et al.: Engineered CRISPR-Cas12a variants with increased activities and improved targeting ranges for gene, epigenetic and base editing. Nature Biotechnology 37(3): 276-282 (2019).
Knott, et al. Guide-bound structures of an RNA-targeting A-cleaving CRISPR-Cas13a enzyme. Nature Structural & Molecular Biology, 24.10 (Oct. 2017): 13 pages.
Kodak (Gel Logic 100 System User's Guide, 2005, 98 pages) (Year: 2005).
Koonin et al. (2017) Diversity, classification and evolution of CRISPR-Cas systems. Current Opinion in Microbiology, 37:67-78 (Year: 2017).
Koshkin et al. LNA (locked nucleic acids): synthesis of the adenine, cytosine, guanine 5-methylcytosine, thymine and uracil bicyclonucleoside monomers, oligomerisation, and unprecedented nucleic acid recognition. Tetrahedron 54(14):3607-3630 (1998).
Lawi et al.: A Microfluidic Cartridge System for Multiplexed Clinical Analysis. JALA Charlottesv Va. 14(6): 407-412 (2009).
Lee et al.: Directed evolution of CRISPR-Cas9 to increase its specificity. Nature Communications 9(1): 3048. 10 pages (2018).
Li, et al. CRISPR-Cas12a has both cis- and trans-cleavage activities on single-stranded DNA. Cell Res. Apr. 2018;28(4):491-493. doi: 10.1038/s41422-018-0022-x. Epub Mar. 12, 2018.
Li, et al. Using molecular beacons as a sensitive fluorescence assay for enzymatic cleavage of single-stranded DNA. Nucleic Acids Res. Jun. 1, 2000;28(11):E52.
Liang et al.: Genotyping genome-edited mutations in plants usingCRISPR ribonucleoprotein complexes. Plant Biotechnology Journal 16: 2053-2062 (2018).
Liu, et al.; "CasX enzymes comprise adistinct family of RNA-guided genome editors"; Nature; vol. 566, pp. 23pages (Feb. 14, 2019).
Liu et al.: Synthetic chimeric nucleases function for efficient genome editing. Nature Communications 10(1): 5524. 11 pages (2019).
Liu, et al. The Molecular Architecture for RNA-Guided RNA Cleavage by Cas13a. Cell, 170 (Aug. 10, 2017): 714-726.
Liu, et al. Two Distant Catalytic Sites Are Responsible for C2c2 RNase Activities. Cell, (Jan. 12, 2017): 168, 121-134.
Livak, et al. Oligonucleotides with fluorescent dyes at opposite ends provide a quenched probe system useful for detecting PCR product and nucleic acid hybridization. PCR Methods Appl. Jun. 1995;4(6):357-62.
Makarova et al.: Evolutionary classification of CRISPR-Cas systems: a burst of class 2 and derived variants. Nat Rev Microbiol. 18(2): 67-83 (2020) [Review Article published Dec. 19, 2019].
Martin. A New Access to 2'-O-Alkylated Ribonucleosides and Properties of 2'-O-Alkylated Oligoribonucleotides. Helv. Chim. Acta. 1995; 78:486-504. (in German with English abstract).
Mauk et al.: Microfluidic devices for nucleic acid (NA) isolation, isothermal NA amplification, and real-time detection. Methods Mol. Biol. 1256: 15-40 (2015).
Maxwell et al.: A detailed cell-free transcription-translation-based assay to decipher CRISPR protospacer-adjacent motifs. Methods 143: 48-57 (2018).
Miao et al.: Systematically investigating the key features of the nuclease deactivated Cpf1 for tunable multiplex genetic regulation. bioRxiv. 23 pages (2018).
Mirkin, C.: Interview: An interview with Chad Mirkin: nanomedicine expert. Interviewed by Hannah Stanwix. Nanomedicine (Lond). 7(5): 635-638 (2012).
Murugan et al.: The Revolution Continues: Newly Discovered Systems Expand the CRISPR-Cas Toolkit. Molecular Cell 68(1): 15-25 (2017).
Nair et al.: Multivalent N-acetylgalactosamine-conjugated siRNA localizes in hepatocytes and elicits robust RNAi-mediated gene silencing. J Am Chem Soc. 136(49): 16958-16961 (2014).
Ngo et al. Computational complexity, protein structure prediction, and the levinthal paradox. In: The Protein Folding Problem and Tertiary Structure Prediction. K. Merz, Jr., et al. Eds. 1994:433-506.
O'Connell, M.R.: Molecular Mechanisms of RNA Targeting by Cas13-containing Type VI CRISPR-Cas Systems. J Mol Biol. 431(1): 66-87 (2019).
Panyam et al.: Biodegradable nanoparticles for drug and gene delivery to cells and tissue. Advanced Drug Delivery Reviews 55(3): 329-347 (2003).
PCT/US2019/044763 International Search Report and Written Opinion dated Jan. 15, 2020.
PCT/US2020/012276 International Search Report and Written Opinion dated Aug. 3, 2020.
Qin et al.: Rapid and fully microfluidic ebola virus detection with CRISPR-Cas13a. ACS. Sens.4(4): 1048-1054 (2019).
Qiu et al.: Microfuidic channel optimization to improve hydrodynamic dissociation of cell aggregates and tissue. Scientific Reports vol. 8, Article No. 2774, pp. 1-10 (2018).
Quan et al.: FLASH: a next-generation CRISPR diagnostic for multiplexed detection of antimicrobial resistance sequences. Nucleic Acids Res. 47(14): e83, 9 pages total (2019).
RNaseAlert Lab Test Kit (Applied Biosystems, Fluorometric RNase Detection Assay, 2008, 12 pages). (Year: 2008).
Rothberg, et al. An integrated semiconductor device enabling non-optical genome sequencing. Nature. 475 (2011): 348-352.
Sato, et al. Highly Sensitive Nuclease Assays Based on Chemically Modified DNA or RNA. Sensors, 14.7 (2014): 12437-12450.
Shah et al.: Single-molecule RNA detection at depth by hybridization chain reaction and tissue hydrogel embedding and clearing. Development. 143(15): 2862-2867 (2016).
Shmakov et al. Discovery and Functional Characterization of Diverse Class 2 CRISPR-Cas Systems. Mol Cell 60(3):385-397 (2015).
Shmakov, et al.: Diversity and evolution of class 2 CRISPR-Cas systems. Nature Reviews Microbiology 15(3): 169-182 (2017).
Singh et al. LNA (locked nucleic acids): synthesis and high-affinity nucleic acid recognition. Chem Commun 4:455-456 (1998).
Smargon, et al. Cas13b is a Type VI-B CRISPR-associated RNA-Guided RNAse differentially regulated by accessory proteins Csx27 and Csx28. Molecular Cell, 65.4, (Feb. 16, 2017): 618-630.
Smith et al. Comparison of Biosequences. Advances in Applied Mathematics. 2:482-489 (1981).
Smith et al.: Microfluidic Cartridges for Automated, Point-of-Care Blood Cell Counting. SLAS Technology 22(2): 176-185 (2017).

(56) References Cited

OTHER PUBLICATIONS

Spoelstra et al.: CRISPR-based DNA and RNA detection with liquid phase separation. bioRxiv preprint doi: https://doi.org/10.1101/471482 . 20 pages total (2018).
Stephen Floor; "CV"; 6 pages (Jun. 11, 2018).
Stephen Floor; "Tweets cited in third party observation filed on Oct. 15, 2018"; 1 page (date of tweets are May 21, 2016).
Sternberg et al. DNA interrogation by the CRISPR RNA-guided endonuclease Cas9. Nature 507(7490):62-67 (2014).
Straub et al.: Zinc fingers, TAL effectors, or Cas9-based DNA binding proteins: what's best for targeting desired genome loci? Mol Plant. 6(5): 1384-1387 (2013).
Swarts et al.: Mechanistic Insights into the cis- and trans-Acting DNase Activities of Cas12a. Mol Cell. 73: 589-600 (2019).
Swarts et al.: Structural Basis for Guide RNA Processing and Seed-Dependent DNA Targeting by CRISPR-Cas12a. Molecular Cell 66(2): 221-233 (2017).
Tambe et al.: RNA Binding and HEPN-Nuclease Activation Are Decoupled in CRISPR-Cas13a. Cell Rep.24(4): 1025-1036 (2018).
Teng et al.: Enhanced mammalian genome editing by new Cas12a orthologs with optimized crRNA scaffolds. Genome Biology 20(1): 15. 6 pages (2019).
Third Party Observations filed on Oct. 15, 2018 in UK patent application No. GB 1804822.3 (18 pages).
U.S. Appl. No. 16/281,939 Office Action dated Nov. 10, 2020.
U.S. Appl. No. 16/577,696 Final Office Action dated Sep. 9, 2020.
U.S. Appl. No. 16/577,696 Office Action dated Apr. 22, 2020.
U.S. Appl. No. 16/577,740 Final Office Action dated Sep. 8, 2020.
U.S. Appl. No. 16/577,740 Office Action dated Apr. 22, 2020.
Wahlestedt et al. Potent and nontoxic antisense oligonucleotides containing locked nucleic acids. PNAS USA 97:5633-5638 (2000).
Wang et al.: Cyclohexene Nucleic Acids (CeNA): Serum Stable Oligonucleotides that Activate RNase H and Increase Duplex Stability with Complementary RNA. J. Am. Chem. Soc. 122(36): 8595-8602 (2000).
Weintraub, K.: Biomedicine: The new gold standard. Nature. 495(7440): S14-S16 (2013).
Xia et al.: Colorimetric detection of DNA, small molecules, proteins, and ions using unmodified gold nanoparticles and conjugated polyelectrolytes. Proc Natl Acad Sci U S A. 107(24): 10837-10841 (2010).
Xie et al.: Optimization of a Microfluidic Cartridge for Lab-on-a-Chip (LOC) Application and Bio-Testing for DNA/RNA Extraction. 2008 58th Electronic Components and Technology Conference. 1310-1316 (2008).
Xu et al.: A gold-nanoparticle-based real-time colorimetric screening method for endonuclease activity and inhibition. Angew Chem Int Ed Engl. 46(19): 3468-3470 (2007) .
Yan et al. (2018) Cas13d Is a Compact RNA-Targeting Type VI CRISPR Effector Positively Modulated by a WYL-Domain-Containing Accessory Protein. Molecular Cell, 70(2):327-339 (Year: 2018).
Yang et al. Using Molecular Beacons for Sensitive Fluorescence Assays of the Enzymatic Cleavage of Nucleic Acids, from: Methods in Molecular Biology, vol. 335: Fluorescent Energy Transfer Nucleic Acid Probes: Designs and Protocols, Edited by V. V. Didenko (Totowa, NJ, Humana Press Inc., 2006), pp. 71-81.
Young et al.: Hollow spherical nucleic acids for intracellular gene regulation based upon biocompatible silica shells. Nano Lett. 12(7): 3867-3871 (2012).
Zangheri et al.: Microfluidic cartridge with integrated array of amorphous silicon photosensors for chemiluminescence detection of viral DNA. Sensing and Bio-Sensing Research 7: 127-132 (2016).
Zanoli et al. Isothermal Amplification Methods for the Detection of Nucleic Acids in Microfluidic Devices. Biosensors 3:18-43 (2013).
Zetsche et al. Cpf1 is a single RNA-guided endonuclease of a class 2 CRISPR-Cas system. Cell 163:759-771 (2015).
Zhang et al.: A Strategy for increasing drug solubility and efficacy through covalent attachment to polyvalent DNA—nanoparticle conjugates. ACS Nano.5(9): 6962-6970 (2011).
Zhang, et al. Antibody-linked spherical nucleic acids for cellular targeting. JACS, 2012, vol. 134, Issue 40, p. 16488-16491.
Zhang et al. Design of a Molecular Beacon DNA Probe with Two Fluorophores. Angewandte Chemi, 113.2 (2001): 416-419.
Zhang, et al., PowerBLAST: A New Network BLAST Application for Interactive or Automated Sequence Analysis and Annotation, Genome Res. 1997, 7:649-656.
Zheng et al.: Topical delivery of siRNA-based spherical nucleic acid nanoparticle conjugates for gene regulation. Proc Natl Acad Sci U S A.109(30): 11975-11980 (2012).
Zhong et al.: Improving Plant Genome Editing with High-Fidelity xCas9 and Non-canonical PAM-Targeting Cas9-NG. Molecular Plant 12(7): 1027-1036 (2019).
GenBank OHA03494.1 (hypothetical protein A3J58_03210 [Candiatus Sung bacterial bacterium FIFCSPH IGHO2_02_FULL_52_23], NCBI Reference Sequence, priority to Oct. 21, 2016, 2 pages) (Year:2016).
U.S. Appl. No. 17/037,594 Non-Final Office Action dated Feb. 3, 2021.
U.S. Appl. No. 16/927,351 Restriction Requirement dated Dec. 30, 2020.
JGI Accession No. 3300001485.a:rank08_10079266, available at https://img.jgi.doe.gov/cgi-bin/m/main.cgi?section=MetaGeneDetail&page=metaGeneDetail&data type=assembled&taxon _oid=3300001485&gene_oid=rank08_100079266.
JGI Accession No. 3300002641.a:loc:_1087029066, available at https://img.jgi.doe.gov/cgi-bin/m/main.cgi?section=MetaGeneDetail&page=metaGeneDetail&data type=assembled&taxon _oid=3300002641 &gene_oid=loc_1087029066.
JGI Accession No. 3300021256.a:Ga0223826_100122715, available at https://img.jgi.doe.gov/cgi-bin/m/main.cgi?section=MetaGeneDetail&page=metaGeneDetail&data type=assembled&taxon _oid=3300021256&gene_oid=Ga0223826_100122715.
JGI Accession No. 3300021387.a:Ga0223845_1127145287, available at https://img.jgi.doe.gov/cgi-bin/m/main.cgi?section=MetaGeneDetail&page=metaGeneDetail&data type=assembled&taxon _oid=3300021387&gene_oid=Ga0223845_1127145287.
Koonin et al.. Origins and evolution of CRISPR-Cas systems. Phil Trans R. Soc. B 374(1772) 6 pages (2019).
PCT/US2020/038242 International Search Report and Written Opinion dated Jan. 28, 2021.
U.S. Appl. No. 15/920,161 Non-Final Office Action dated Jul. 16, 2021.
U.S. Appl. No. 16/281,939 Non-Final Office Action dated Aug. 3, 2021.
U.S. Appl. No. 16/896,731 Non-Final Office Action dated Mar. 19, 2021.
U.S. Appl. No. 16/927,351 Final Office Action dated May 14, 2021.
U.S. Appl. No. 16/927,351 Non-Final Office Action dated Mar. 9, 2021.
U.S. Appl. No. 17/037,592 Non-Final Office Action dated Apr. 8, 2021.
U.S. Appl. No. 17/037,594 Final Office Action dated Jun. 15, 2021.

\* cited by examiner

Forward outer primer:

Backward outer primer:

Forward inner primer (FIP):

Backward inner primer (BIP):

Loop forward primer (optional):

Loop backward primer (optional):

5' CCAGTTTCATTTGAGCATTAAGTGTCAAGTTCTG 3' (SEQ ID NO:750)
3' GGTCAAAGTAAACTCGTAATTCACAGTTCAAGAC 5' (SEQ ID NO:751)

gRNA

Br: Brown          Brown \*: A SNP Positive Control
Bl: Blue           Blue \*: G SNP Positive Control

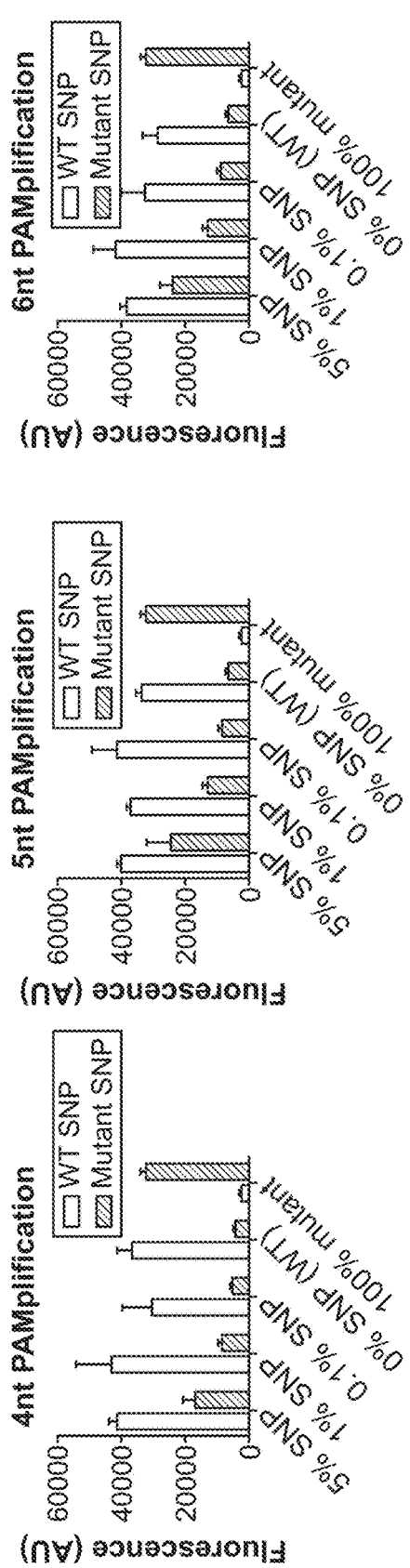
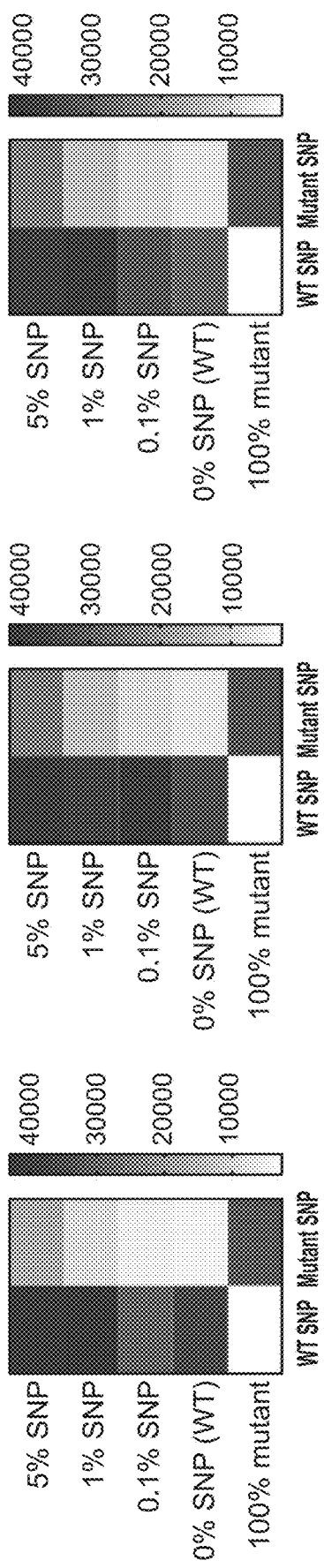
FIG. 58A  FIG. 58B  FIG. 58C

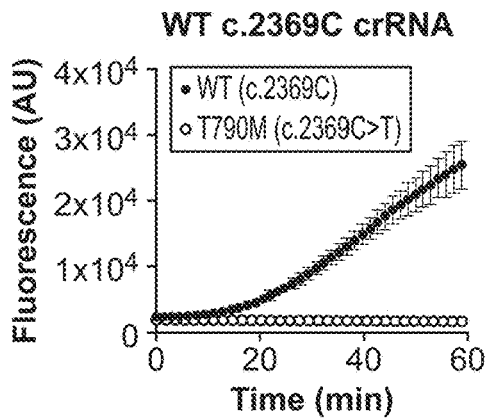
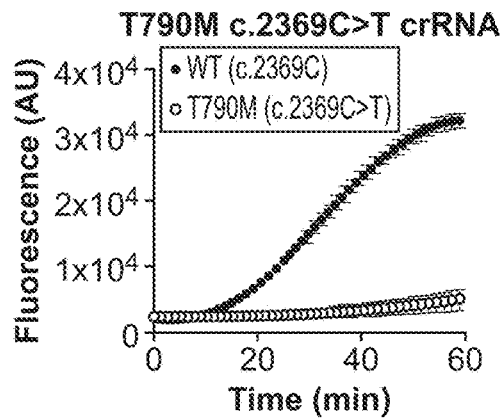
FIG. 59A
FIG. 59B
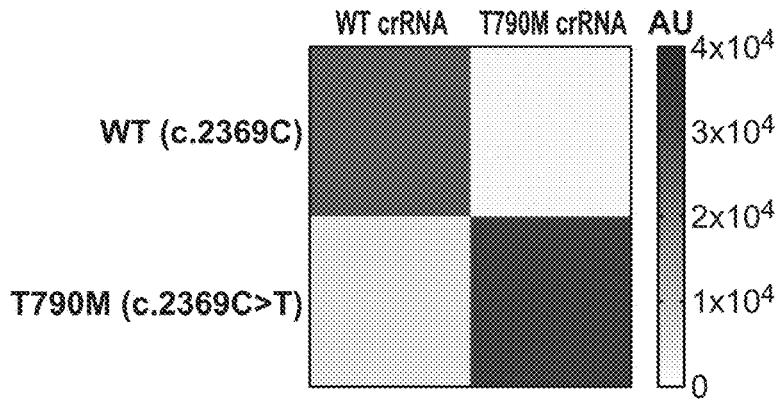
FIG. 59C
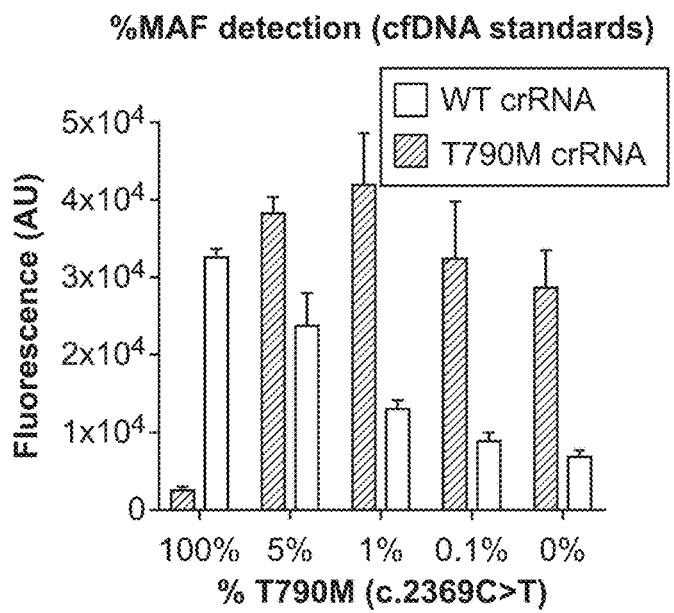
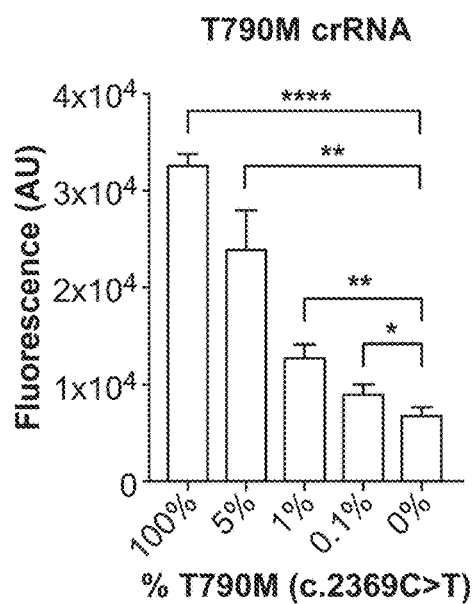
FIG. 60A
FIG. 60B

| | Roche cobas EGFR Mutation test v2 | PCR + CRISPR |
|---|---|---|
| Sample | Tissue | cfDNA standards |
| Input | 50 ng purified DNA | 2 ng purified DNA |
| Detection sensitivity | ≤ 5% | ≤ 1% |
| Sensitivity | 94.0% | N/A |
| Specificity | 97.7% | N/A |
| TAT | 1 day | 2 hours |
| Hands-on time | 4 hours (including sample prep) | <30 minutes (not including sample prep) |

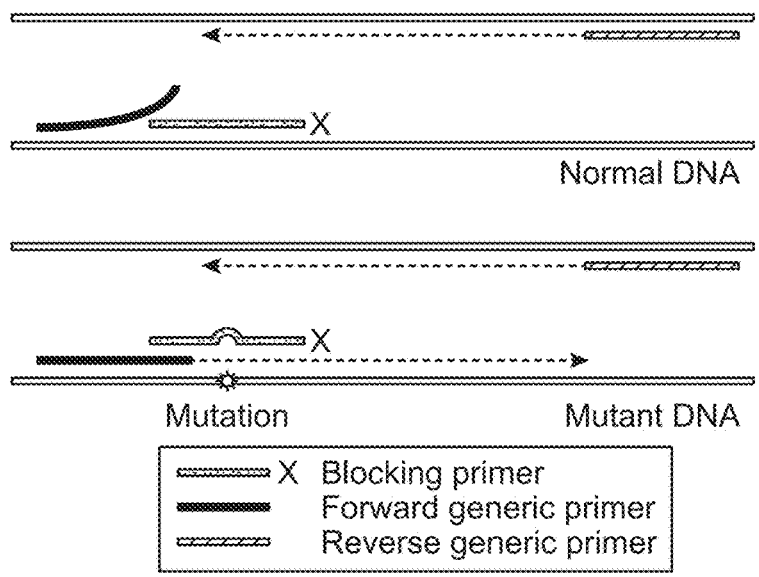
FIG. 63A
FIG. 63B
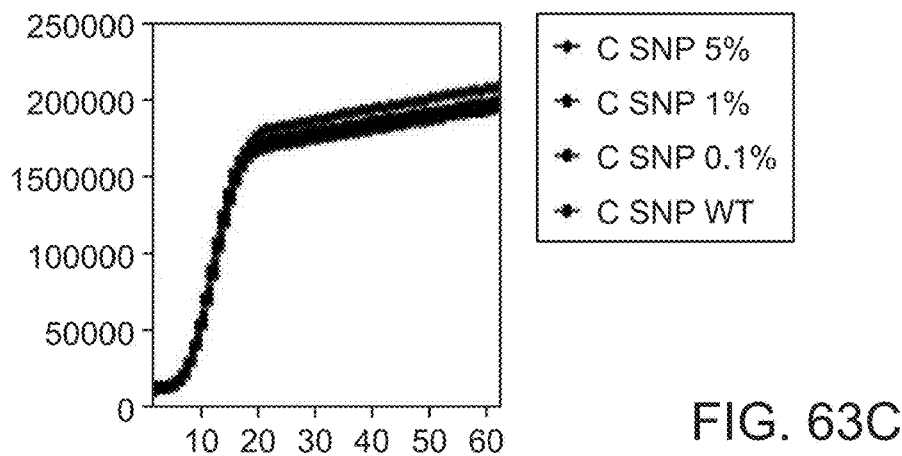
FIG. 63C
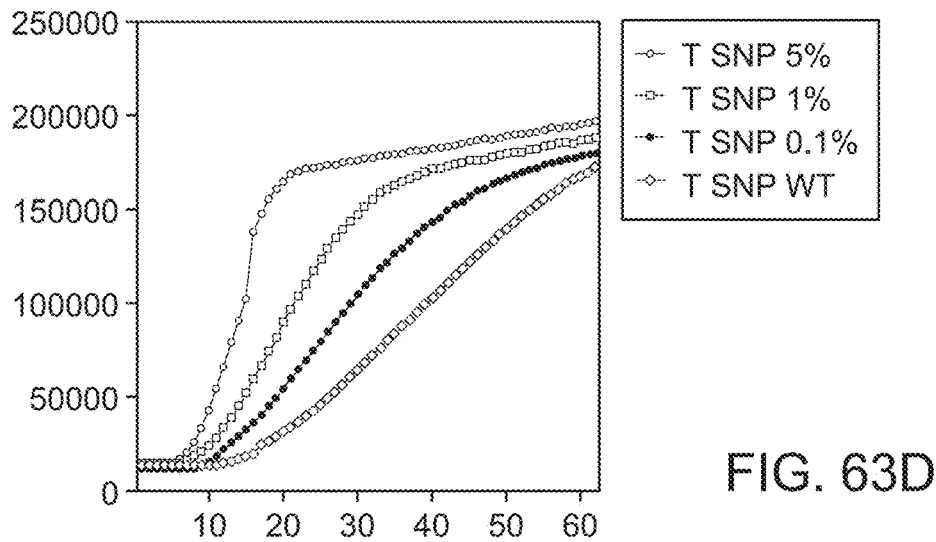
FIG. 63D

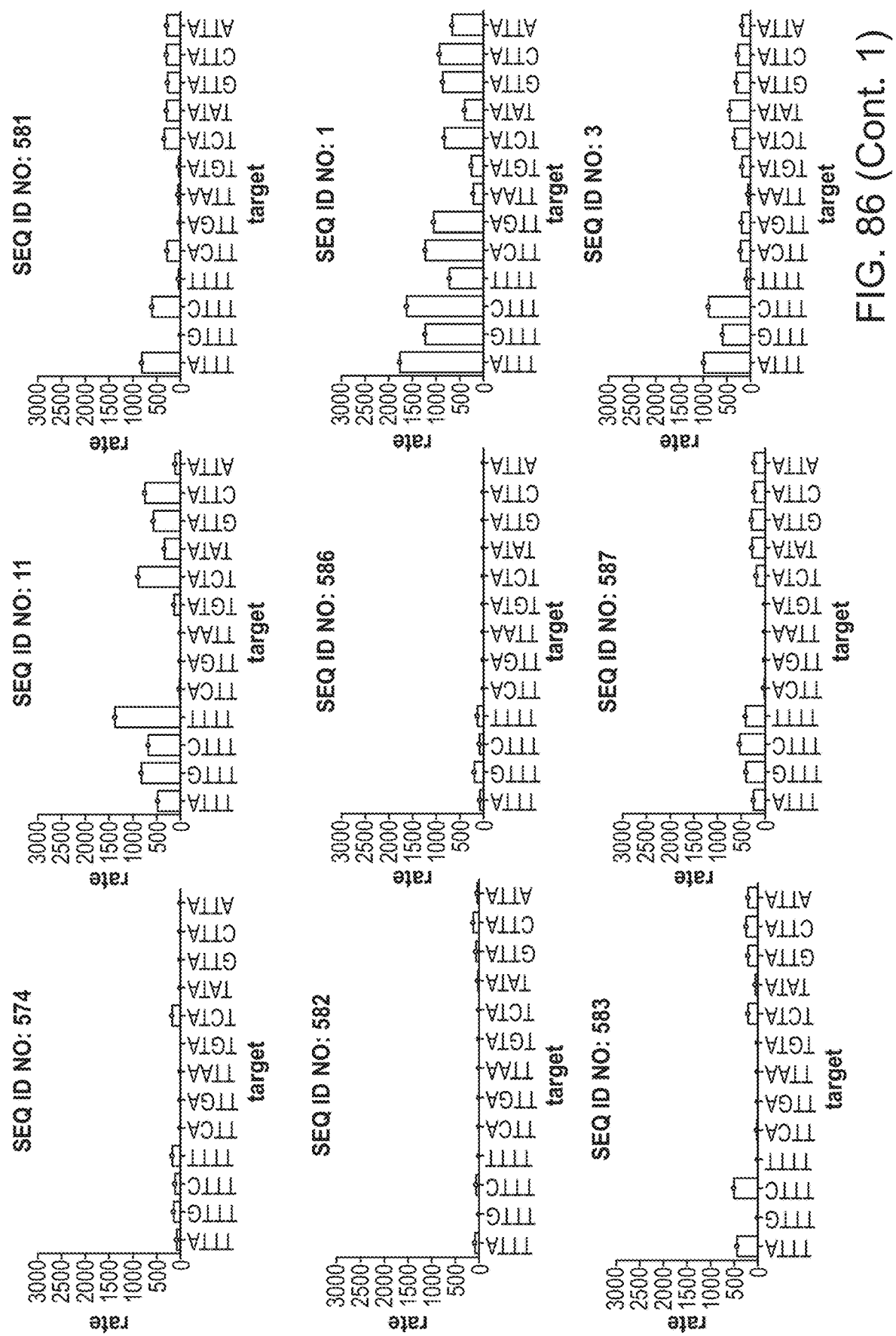
FIG. 86 (Cont. 1)

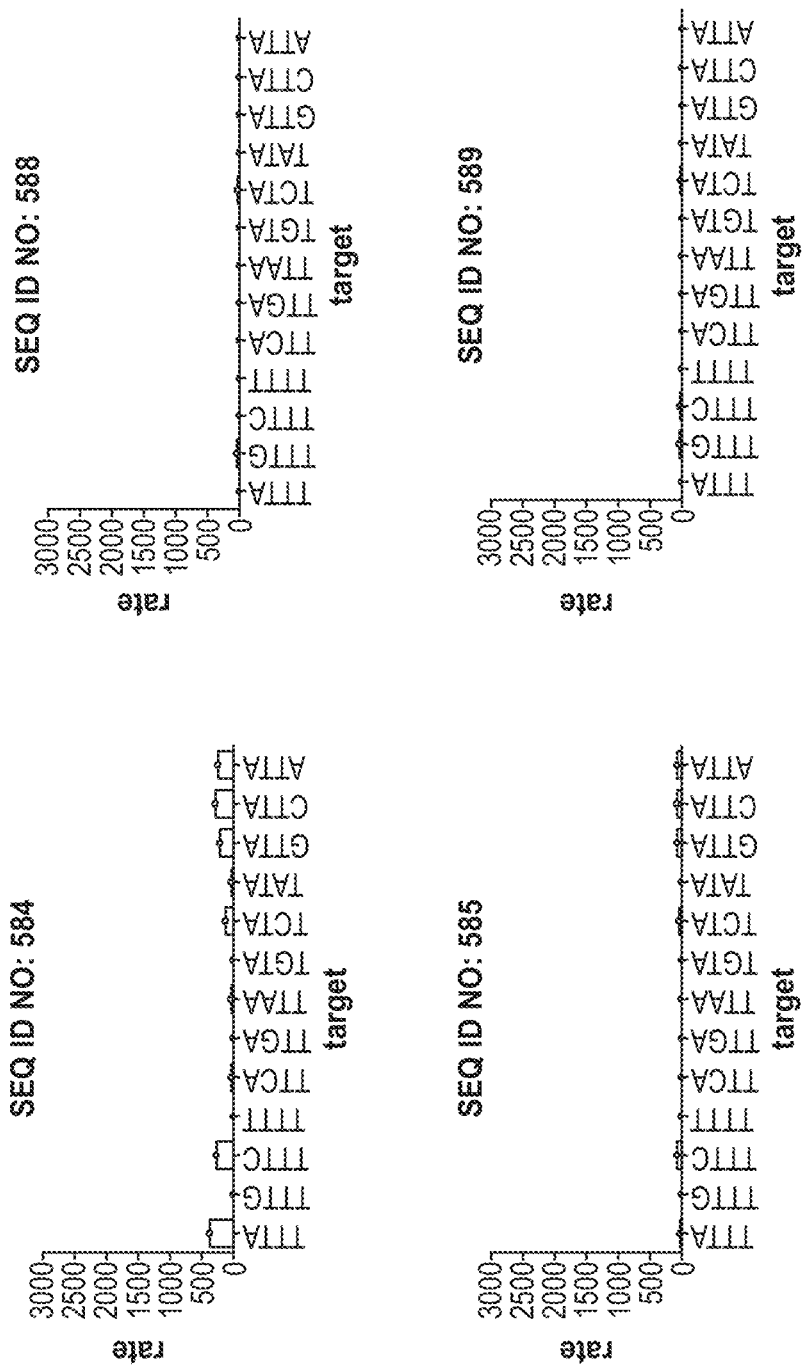
FIG. 86 (Cont. 2)

FIG. 92

PROGRAMMABLE NUCLEASE IMPROVEMENTS AND COMPOSITIONS AND METHODS FOR NUCLEIC ACID AMPLIFICATION AND DETECTION

CROSS-REFERENCE

This application is a continuation of PCT International Application No. PCT/US2020/012276, filed Jan. 3, 2020, which claims priority to and the benefit from U.S. Provisional Application Nos. 62/788,706 filed Jan. 4, 2019, 62/894,515 filed Aug. 30, 2019, 62/944,939 filed Dec. 6, 2019, 62/788,704 filed Jan. 4, 2019, 62/795,463 filed Jan. 22, 2019, 62/863,166 filed Jun. 18, 2019, 62/881,801 filed Aug. 1, 2019, and 62/944,933 filed Dec. 6, 2019, the entire contents of each of which are herein incorporated by reference.

SEQUENCE LISTING

The instant application contains a Sequence Listing which has been submitted electronically in ASCII format and is hereby incorporated by reference in its entirety. Said ASCII copy, created on Mar. 12, 2020, is named 53694-724_601_SL.txt and is 1,291,429 bytes in size.

BACKGROUND

CRISPR/Cas-based diagnostics can be very useful for early detection of nucleic acids associated with disease, however, there still exists a need for formulations of Cas proteins and reagents that exhibit optimal activity in diagnostic assays.

Assaying of a target nucleic acid comprising a mutation can be difficult, especially in the presence of a nucleic acid comprising a variant of the mutation because the mutation is the only difference between the sequences of these nucleic acids. This becomes more difficult when the mutation is a single nucleotide mutation. Additionally, it is often difficult to assay for the target nucleic acid comprising the mutation when the sample comprising the target nucleic acid also comprises more of the nucleic acid comprising the variant of the mutation than the target nucleic acid comprising the mutation. Therefore, there is a need for enhanced detection of a target nucleic acid with a mutation in a sample also comprising a nucleic acid comprising a variant of the mutation.

There are many target nucleic acids of interest that do not encode for the PAM sequence. However, a target nucleic acid is may need a PAM sequence for binding and trans cleavage activation of some programmable nucleases complexed with a guide nucleic acid. Therefore, there is a need for strategies to allow for binding and trans cleavage activation of the programmable nucleases complexed with a guide nucleic acid using any target nucleic sequence of interest.

SUMMARY

In various aspects, the present disclosure provides a composition comprising a programmable nuclease having at least 60% sequence identity to SEQ ID NO: 11 and a non-naturally occurring guide nucleic acid.

In some aspects, the programmable nuclease comprises a turnover rate of at least about 0.1 cleaved detector nucleic acid molecules per minute. In some aspects, the programmable nuclease recognizes a protospacer adjacent motif of YYN.

In various aspects, the present disclosure provides a composition comprising programmable nuclease having a turnover rate of at least about 0.1 cleaved detector nucleic acid molecules per minute and a non-naturally occurring guide nucleic acid.

In some aspects, the programmable nuclease recognizes a protospacer adjacent motif of YYN.

In various aspects, the present disclosure provides a composition comprising a non-naturally occurring guide nucleic acid and a programmable nuclease, wherein the programmable nuclease comprises a turnover rate of at least about 0.1 cleaved detector nucleic acid molecules per minute and recognizes a protospacer adjacent motif of YYN.

In some aspects, the programmable nuclease is a Type V programmable nuclease. In some aspects, the programmable nuclease is a Cas12 nuclease. In some aspects, the programmable nuclease comprises three partial RuvC domains. In some aspects, the programmable nuclease comprises a RuvC-I subdomain, a RuvC-II subdomain, and a RuvC-III subdomain.

In some aspects, the programmable nuclease has at least 60% sequence identity to SEQ ID NO: 11. In some aspects, the programmable nuclease has at least 70%, at least 75%, at least 80%, at least 85%, at least 90%, at least 92%, at least 95%, at least 97%, or at least 99% sequence identity to SEQ ID NO: 11. In some aspects, the programmable nuclease is SEQ ID NO: 11.

In some aspects, the Y is a C or T nucleotide. In some aspects, the N is any nucleotide. In some aspects, the composition further comprises a buffer. In some aspects, the buffer comprises a buffering agent, a salt, a crowding agent, a detergent, or any combination thereof.

In some aspects, the buffering agent is at a concentration of from 5 mM to 100 mM. In some aspects, the buffering agent is at a concentration of from 10 mM to 40 mM. In some aspects, the buffering agent is at a concentration of about 20 mM. In some aspects, the salt is from 5 mM to 100 mM. In some aspects, the salt is from 5 mM to 10 mM. In some aspects, the crowding agent is from 0.5% (v/v) to 2% (v/v). In some aspects, the crowding agent is about 1% (v/v). In some aspects, the detergent is about 2% (v/v) or less In some aspects, the detergent is about 0.00016% (v/v). In some aspects, the buffering agent is HEPES. In some aspects, the salt is potassium acetate, magnesium acetate, sodium chloride, magnesium chloride, or any combination thereof.

In some aspects, the crowding agent is glycerol. In some aspects, the detergent is Tween, Triton-X, or any combination thereof. In some aspects, a pH of the composition is from 7 to 8. In some aspects, a pH of the composition is 7.5. In some aspects, the composition is at a temperature of from 25° C. to 45° C. In some aspects, the programmable nuclease exhibits catalytic activity at a temperature of from 25° C. to 45° C. In some aspects, the programmable nuclease exhibits catalytic activity after heating the composition to a temperature of greater than 45° C. and restoring the temperature to from 25° C. to 45° C.

In various aspects, the present disclosure provides a method of assaying for a segment of a target nucleic acid in a sample, the method comprising: contacting the sample to: a detector nucleic acid; and any of the above described compositions, wherein the guide nucleic acid hybridizes to a segment of the target nucleic acid; and assaying for a signal produced by cleavage of the detector nucleic acid.

In various aspects, the present disclosure provides a method of assaying for a segment of a target nucleic acid in a sample from a subject comprising: contacting the sample comprising a population of nucleic acids to: a guide nucleic acid that hybridizes to the segment of the target nucleic acid; a detector nucleic acid; and a Cas12 nuclease that cleaves the detector nucleic acid upon hybridization of the guide nucleic acid to the segment of the target nucleic acid; and assaying for a signal produced by cleavage of the detector nucleic acid, wherein the signal is at least two-fold greater when the segment of the target nucleic acid is present in the sample than the signal when the sample lacks the segment of the target nucleic acid and wherein the subject has a disease when the segment of the target nucleic acid is present.

In some aspects, the method further comprising administering a treatment for the disease.

In various aspects, the present disclosure provides a method of assaying for a segment of a target nucleic acid comprising: contacting a sample comprising a population of nucleic acids, wherein the population comprises at least one nucleic acid comprising a segment having less than 100% sequence identity to the segment of the target nucleic acid and having no less than 50% sequence identity to the segment of the target nucleic acid to: a guide nucleic acid that hybridizes to the segment of the target nucleic acid; a detector nucleic acid; and a Cas12 nuclease that cleaves the detector nucleic acid upon hybridization of the guide nucleic acid to the segment of the target nucleic acid; and assaying for a signal produced by cleavage of the detector nucleic acid, wherein the signal is at least two-fold greater when the segment of the target nucleic acid is present in the sample than the signal when the sample lacks the segment of the target nucleic acid.

In some aspects, the segment of the at least one nucleic acid comprises at least two base mutations compared to the segment of the target nucleic acid. In some aspects, the segment of the at least one nucleic acid comprises from one to ten base mutations compared to the segment of the target nucleic acid. In some aspects, the segment of the at least one nucleic acid comprises one base mutation compared to the segment of the target nucleic acid. In some aspects, the signal is from two-fold to 20-fold greater when the segment of the target nucleic acid is present in the sample than the signal when the sample lacks the segment of the target nucleic acid. In some aspects, the signal is from two-fold to 10-fold greater when the segment of the target nucleic acid is present in the sample than the signal when the sample lacks the segment of the target nucleic acid. In some aspects, the signal is from five-fold to 10-fold greater when the segment of the target nucleic acid is present in the sample than the signal when the sample lacks the segment of the target nucleic acid.

In some aspects, the guide nucleic acid is reverse complementary to the segment of the target nucleic acid In some aspects, the guide nucleic acid and the second guide nucleic acid lack synthetic mismatches. In some aspects, the guide nucleic acid is at least 10 bases. In some aspects, the guide nucleic acid is from 10 to 50 bases. In some aspects, the guide nucleic acid is at least 25 bases. In some aspects, the target nucleic acid is in the population of nucleic acids at a minor allele frequency of 10% or less. In some aspects, the target nucleic acid is in the population of nucleic acids at a minor allele frequency of from 0.1% to 10%. In some aspects, the target nucleic acid is in the population of nucleic acids at a minor allele frequency of from 0.1% to 5%. In some aspects, the target nucleic acid is in the population of nucleic acids at a minor allele frequency of from 0.1% to 1%.

In some aspects, the Cas12 nuclease is Cas12a, Cas12b, Cas12c, CasY, or Cas12e. In some aspects, the Cas12 nuclease is Cas12a. In some aspects, the Cas12 nuclease has at least 60%, at least 70%, at least 80%, at least 85%, at least 90%, at least 92%, at least 95%, at least 97%, at least 99%, or 100% sequence identity to any one of SEQ ID NO: 1-SEQ ID NO: 11, SEQ ID NO: 282, or SEQ ID NO: 571-SEQ ID NO: 602. In some aspects, the Cas12 nuclease has at least 60% sequence identity to SEQ ID NO: 11.

In some aspects, the contacting is carried out in a buffer comprising a buffering agent, a salt, a crowding agent, a detergent, a reducing agent, a competitor, or any combination thereof. In some aspects, the buffering agent is at a concentration of from 5 mM to 100 mM. In some aspects, the buffering agent is at a concentration of from 10 mM to 30 mM. In some aspects, the salt is from 5 mM to 100 mM. In some aspects, the salt is from 5 mM to 10 mM. In some aspects, the crowding agent is from 0.5% (v/v) to 10% (v/v). In some aspects, the crowding agent is from 1% (v/v) to 5% (v/v). In some aspects, the detergent is at 2% (v/v) or less In some aspects, the reducing agent is from 0.01 mM to 100 mM. In some aspects, the reducing agent is from 0.1 mM to 10 mM. In some aspects, the reducing agent is from 0.5 mM to 2 mM. In some aspects, the competitor is from 1 ug/ml to 100 ug/ml. In some aspects, the competitor is from 40 ug/ml to 60 ug/ml.

In some aspects, the buffering agent is HEPES, Tris, or any combination thereof. In some aspects, the salt is potassium acetate, magnesium acetate, sodium chloride, magnesium chloride, or any combination thereof. In some aspects, the crowding agent is glycerol. In some aspects, the detergent is Tween, Triton-X, or any combination thereof. In some aspects, the reducing agent is DTT. In some aspects, the competitor is heparin. In some aspects, a pH of the composition is from 7 to 8.

In some aspects, the method further comprises amplifying the target nucleic acid before the contacting. In some aspects, the amplifying the target nucleic acid before the contacting comprises using a blocking primer. In some aspects, the target nucleic acid segment comprises a single nucleotide mutation. In some aspects, the blocking primer binds to a nucleic acid comprising encoding the wild type sequence of the target nucleic acid segment. In some aspects, the amplifying comprises COLD-PCR. In some aspects, the COLD-PCR comprises full COLD-PCR. In some aspects, the COLD-PCR comprises fast COLD-PCR. In some aspects, the amplifying comprises fast COLD-PCR. In some aspects, the amplifying comprises allele-specific PCR. In some aspects, the amplifying further comprises COLD-PCR.

In various aspects, the present disclosure provides a composition comprising a programmable nuclease and a buffer, wherein the buffer comprises a salt at less than about 110 mM and wherein the buffer comprises a pH of from 7 to 8.

In some aspects, the salt is from 1 mM to 110 mM. In some aspects, the salt is from 1 mM to 60 mM. In some aspects, the salt is from 1 mM to 10 mM. In some aspects, the salt is at about 105 mM. In some aspects, the salt is at about 55 mM. In some aspects, the salt is at about 7 mM. In some aspects, the salt comprises potassium acetate, magnesium acetate, sodium chloride, magnesium chloride, potassium chloride, or any combination thereof. In some aspects, the salt comprises potassium acetate and magnesium acetate.

In some aspects, the salt comprises sodium chloride and magnesium chloride. In some aspects, the salt comprises potassium chloride and magnesium chloride.

In some aspects, the pH comprises about 7.5. In some aspects, the pH comprises about 8. In some aspects, the buffer comprises a crowding agent or a competitor. In some aspects, the crowding agent is present from 1% (v/v) to 10% (v/v). In some aspects, the crowding agent or the competitor is present from 1% (v/v) to 5% (v/v). In some aspects, the crowding agent or the competitor is present at about 5% (v/v). In some aspects, the crowding agent or the competitor is present at about 1% (v/v). In some aspects, the crowding agent or the competitor is present from 1 ug/mL to 100 ug/ml. In some aspects, the crowding agent or the competitor is present from 30 ug/ml to 70 ug/ml. In some aspects, the crowding agent or the competitor is present at about 50 ug/ml. In some aspects, the crowding agent or the competitor is present from 1 mM to 50 mM. In some aspects, the crowding agent or the competitor is present from 10 mM to 30 mM. In some aspects, the crowding agent or the competitor is present at about 20 mM.

In some aspects, the crowding agent or the competitor is selected from the group consisting of: glycerol, heparin, bovine serum albumin, imidazole, and any combination thereof. In some aspects, the crowding agent or the competitor comprises glycerol. In some aspects, the crowding agent or the competitor comprises glycerol and heparin. In some aspects, the crowding agent or the competitor comprises glycerol, bovine serum albumin, and imidazole. In some aspects, the buffer comprises a buffering agent. In some aspects, the buffering agent is present from 1 mM to 50 mM. In some aspects, the buffering agent is present from 1 mM to 30 mM. In some aspects, the buffering agent is present at about 20 mM. In some aspects, the buffering agent is HEPES. In some aspects, the buffering agent is Tris.

In some aspects, the buffer comprises a detergent. In some aspects, the detergent is present from 0.00001% (v/v) to 0.1% (v/v). In some aspects, the detergent is present from 0.00001% (v/v) to 0.01% (v/v). In some aspects, the detergent is at about 0.00016% (v/v). In some aspects, the detergent is at about 0.01% (v/v). In some aspects, the detergent is Triton-X. In some aspects, the detergent is IGEPAL CA-630. In some aspects, the buffer comprises a reducing agent. In some aspects, the reducing agent is present from 0.01 mM to 100 mM. In some aspects, the reducing agent is present from 0.1 mM to 10 mM. In some aspects, the reducing agent is present at about 1 mM. In some aspects, the reducing agent is DTT.

In some aspects, the programmable nuclease comprises a RuvC domain. In some aspects, the programmable nuclease comprises a Type V Cas protein. In some aspects, the programmable nuclease is a Cas12 protein. In some aspects, the Cas12 protein is Cas12a, Cas12b, Cas12c, CasY, or Cas12e. In some aspects, the programmable nuclease has at least 60%, at least 70%, at least 80%, at least 85%, at least 90%, at least 92%, at least 95%, at least 97%, at least 99%, or 100% sequence identity to any one of SEQ ID NO: 1-SEQ ID NO: 11, SEQ ID NO: 282, or SEQ ID NO: 571-SEQ ID NO: 602. In some aspects, the programmable nuclease has at least 60%, at least 70%, at least 80%, at least 85%, at least 90%, at least 92%, at least 95%, at least 97%, at least 99%, or 100% sequence identity to SEQ ID NO: 1. In some aspects, the programmable nuclease has at least 60%, at least 70%, at least 80%, at least 85%, at least 90%, at least 92%, at least 95%, at least 97%, at least 99%, or 100% sequence identity to SEQ ID NO: 11. In some aspects, the programmable nuclease comprises at least two HEPN domains.

In some aspects, the programmable nuclease is a Type VI Cas protein. In some aspects, the programmable nuclease is a Cas13 protein. In some aspects, the Cas13 protein is Cas13a, Cas13b, Cas13c, Cas13d, or Cas13e. In some aspects, the programmable nuclease has at least 60%, at least 70%, at least 80%, at least 85%, at least 90%, at least 92%, at least 95%, at least 97%, at least 99%, or 100% sequence identity to any one of SEQ ID NO: 103-SEQ ID NO: 137. In some aspects, the programmable nuclease has at least 60%, at least 70%, at least 80%, at least 85%, at least 90%, at least 92%, at least 95%, at least 97%, at least 99%, or 100% sequence identity to SEQ ID NO: 104.

In some aspects, the programmable nuclease has at least 60%, at least 70%, at least 80%, at least 85%, at least 90%, at least 92%, at least 95%, at least 97%, at least 99%, or 100% sequence identity to SEQ ID NO: 11 and the buffer comprises about 20 mM HEPES, about 2 mM potassium acetate, about 5 mM magnesium acetate, about 1% glycerol, about 0.00016% Triton-X, and a pH of about 7.5. In some aspects, the programmable nuclease has at least 60%, at least 70%, at least 80%, at least 85%, at least 90%, at least 92%, at least 95%, at least 97%, at least 99%, or 100% sequence identity to SEQ ID NO: 1 and the buffer comprises about 20 mM Tris, about 100 mM sodium chloride, about 5 mM magnesium chloride, about 5% glycerol, about 50 ug/mL heparin, about 1 mM DTT, and a pH of about 8. In some aspects, the programmable nuclease has at least 60%, at least 70%, at least 80%, at least 85%, at least 90%, at least 92%, at least 95%, at least 97%, at least 99%, or 100% sequence identity to SEQ ID NO: 104 and the buffer comprises about 50 mM potassium chloride, about 5 mM magnesium chloride, about 10 ug/ml bovine serum albumin, about 5% (v/v) glycerol, about 20 mM imidazole, about 0.01% (v/v) IGEPAL CA-630, and a pH of about 7.5. In some aspects, the composition further comprises a guide nucleic acid. In some aspects, the composition further comprises a detector nucleic acid.

In various aspects, the present disclosure provides a composition comprising: a nucleic acid from a sample, wherein the sample comprises a PAM and a segment that hybridizes to a guide nucleic acid, wherein the PAM has a sequence of dUdUdUN; a guide nucleic acid that hybridizes to the segment of the nucleic acid; and a programmable nuclease that exhibits sequence independent cleavage of a detector nucleic acid upon hybridization of the guide nucleic acid to the segment of the target nucleic acid.

In some aspects, the composition further comprises a primer, wherein the primer comprises a first region that is reverse complementary to the PAM and a second region that is reverse complementary to a first segment of the nucleic acid.

In various aspects, the present disclosure provides a method of assaying for a target nucleic acid in a sample, wherein the target nucleic acid lacks a PAM, the method comprising: amplifying the target nucleic acid from a sample using a primer comprising a first region that is reverse complementary to a PAM and a second region that is reverse complementary to a first segment of the target nucleic acid, wherein the PAM is dUdUdUN, thereby producing a PAM target nucleic acid; contacting the PAM target nucleic acid to: a guide nucleic acid that hybridizes to a segment of the PAM target nucleic acid; a programmable nuclease that exhibits sequence independent cleavage of a detector nucleic acid upon hybridization of the guide nucleic acid to a segment of the PAM target nucleic acid; and a detector nucleic acid; and assaying for a signal produced by cleavage of the detector nucleic acid.

In some aspects, the second region comprises from 4 to 12 bases. In some aspects, the second region comprises from 4 to 10 bases. In some aspects, the second region comprises from 4 to 7 bases. In some aspects, the amplifying comprises thermal cycling amplification. In some aspects, the amplifying comprises isothermal amplification. In some aspects, the isothermal amplification comprises isothermal recombinase polymerase amplification (RPA), transcription mediated amplification (TMA), strand displacement amplification (SDA), helicase dependent amplification (HDA), loop mediated amplification (LAMP), rolling circle amplification (RCA), single primer isothermal amplification (SPIA), ligase chain reaction (LCR), simple method amplifying RNA targets (SMART), improved multiple displacement amplification (IMDA), or nucleic acid sequence-based amplification (NASBA). In some aspects, the isothermal amplification comprises loop mediated amplification (LAMP).

In some aspects, a sequence of the primer and a sequence of the guide nucleic acid overlap by 50% or less. In some aspects, a sequence of the primer and a sequence of the guide nucleic acid do not overlap. In some aspects, the primer is a forward primer, a reverse primer, a forward inner primer, or a reverse inner primer. In some aspects, the segment of the nucleic acid or the segment of the target nucleic acid comprises at least one base mutation compared to at least one other segment of a nucleic acid in the sample. In some aspects, the at least one base mutation is no more than 13 nucleotides 3' of the PAM in the nucleic acid or the PAM target nucleic acid. In some aspects, the at least one base mutation is no more than 10 nucleotides 3' of the PAM in the nucleic acid or the PAM target nucleic acid. In some aspects, the at least one base mutation is no more than 9 nucleotides 3' of the PAM in the nucleic acid or in the PAM target nucleic acid. In some aspects, the at least one base mutation is no more than 8 nucleotides 3' of the PAM in the nucleic acid or in the PAM target nucleic acid. In some aspects, the at least one base mutation is a single nucleotide polymorphism.

In some aspects, the programmable nuclease comprises a RuvC domain. In some aspects, the programmable nuclease comprises three partial RuvC domains. In some aspects, wherein the programmable nuclease comprises a RuvC-I subdomain, a RuvC-II subdomain, and a RuvC-III subdomain. In some aspects, the programmable nuclease comprises a Type V Cas protein. In some aspects, the programmable nuclease is a Cas12 protein. In some aspects, the Cas12 protein is Cas12a, Cas12b, Cas12c, CasY, or Cas12e. In some aspects, the programmable nuclease has at least 60%, at least 70%, at least 80%, at least 85%, at least 90%, at least 92%, at least 95%, at least 97%, at least 99%, or 100% sequence identity to any one of SEQ ID NO: 1-SEQ ID NO: 11, SEQ ID NO: 282, SEQ ID NO: 571-SEQ ID NO: 602.

In various aspects, the present disclosure provides a Cas12 nuclease for use in diagnosis, wherein the Cas12 nuclease detects the segment of the target nucleic acid according to any of the above methods.

In some aspects, the present disclosure provides for the use of any of the above compositions in diagnosis.

In various aspects, the present disclosure provides for a programmable nuclease for use in diagnosis, wherein the programmable nuclease detects the target nucleic acid according to any of the above described methods.

Provided herein are embodiments related to improved Cas12, Cas13, and Cas14 proteins and related compositions and methods of use. Embodiments are summarized in part in the claims as listed herein.

In various aspects, the present disclosure provides a programmable nuclease that elicits maximal reporter activity no more than 60 minutes following contacting to a target template at a target template concentration of 100 nM.

In some aspects, the programmable nuclease comprises a Cas12 protein, a Cas13 protein, or a Cas14 protein. In some aspects, said protein elicits maximal reporter activity following contacting to a target template at least 50% faster than LbCas12a at a given target template concentration. In some aspects, said protein elicits maximal reporter activity following contacting to a target template at least 2× faster than LbCas12a at a given target template concentration. In some aspects, said protein elicits maximal reporter activity following contacting to a target template at least 4× faster than LbCas12a at a given target template concentration. In some aspects, said protein elicits no greater than 33% of maximal reporter activity following contacting to a template differing from a target template by a single base at a template concentration of 100 nM. In some aspects, the protein elicits maximal reporter activity in a composition comprising at least one component selected from the list consisting of acetate, heparin, dithiothreitol (DTT), triton-X, TCEP, BSA, NP-40, imidazole, MOPS, HEPES and DIPSO.

In some aspects, the template is unamplified. In some aspects, the template is amplified prior to contacting. In some aspects, the contacting is performed in an activity buffer (5×: 600 mM NaCl, 25 mM MgCl2, 100 mM Tris pH 7.5, 5% (v/v) glycerol). In some aspects, the contacting is performed at about 25° C. In some aspects, the contacting is performed at about 37° C.

In various aspects, the present disclosure provides a programmable nuclease reaction buffer comprising at least one component selected from the list consisting of acetate, heparin, dithiothreitol (DTT), triton-X, TCEP, BSA, NP-40, imidazole, MOPS, HEPES and DIPSO.

In some aspects, the programmable nuclease comprises a Cas12 protein, a Cas13 protein, or a Cas14 protein. In some aspects, the programmable nuclease in said reaction buffer elicits no greater than 33% of maximal reporter activity following contacting to a template differing from a target template by a single base. In some aspects, the reaction buffer comprises no greater than 150 mM NaCl. In some aspects, the reaction buffer comprises no greater than 100 mM NaCl. In some aspects, the reaction buffer comprises no greater than 50 mM NaCl. In some aspects, the reaction buffer comprises no greater than 25 mM NaCl.

In various aspects, the present disclosure provides a programmable nuclease reaction buffer comprising at least one component selected from the list consisting of DMSO, polyvinyl alcohol, polyvinylpyrrolidone, and polypropylene glycol.

In some aspects, the programmable nuclease comprises a Cas12 protein, a Cas13 protein, or a Cas14 protein. In some aspects, the programmable nuclease in said reaction buffer elicits no greater than 33% of maximal reporter activity following contacting to a no-template control. In some aspects, the reaction buffer comprises no greater than 150 mM NaCl. In some aspects, the reaction buffer comprises no greater than 100 mM NaCl. In some aspects, the reaction buffer comprises no greater than 50 mM NaCl. In some aspects, the reaction buffer comprises no greater than 25 mM NaCl.

In various aspects, the present disclosure provides a programmable nuclease that elicits reporter activity no more than 60 minutes following contacting to a target template at a target template concentration of 1 nM in an activity buffer (5×:600 mM NaCl, 25 mM MgCl2, 100 mM Tris pH 7.5, 5% (v/v) glycerol).

In some aspects, the programmable nuclease comprises a Cas12 protein, a Cas13 protein, or a Cas14 protein. In some aspects, the Cas12 protein elicits reporter activity no more than 60 minutes following contacting to a target template at a target template concentration of 1 pM. In some aspects, the Cas12 protein elicits reporter activity no more than 60 minutes following contacting to a target template at a target template concentration of 1 fM.

In various aspects, the present disclosure provides a programmable nuclease that exhibits at least 90% target cleavage in no more than 60 minutes.

In some aspects, the programmable nuclease comprises a Cas12 protein, a Cas13 protein, or a Cas14 protein. In some aspects, the Cas12 protein exhibits at least 90% target cleavage in no more than 15 minutes. In some aspects, an activity buffer (5×:600 mM NaCl, 25 mM MgCl2, 100 mM Tris pH 7.5, 5% (v/v) glycerol) exhibits said target cleavage. In some aspects, said target cleavage is effected at a Cas12 concentration of 100 nM. In some aspects, said target cleavage is effected at a target concentration of 15 nM. In some aspects, said target cleavage is effected at a guide RNA concentration of 125 nM. In some aspects, said target cleavage is effected at a temperature of about 25° C. In some aspects, said target cleavage is effected at a temperature of about 37° C.

In various aspects, the present disclosure provides a programmable nuclease that exhibits no more than 10% target cleavage in 60 minutes.

In some aspects, the programmable nuclease comprises a Cas12 protein, a Cas13 protein, or a Cas14 protein. In some aspects, an activity buffer (5×:600 mM NaCl, 25 mM MgCl2, 100 mM Tris pH 7.5, 5% (v/v) glycerol) exhibits said target cleavage. In some aspects, said target cleavage is effected at a Cas12 concentration of 100 nM. In some aspects, said target cleavage is effected at a target concentration of 15 nM. In some aspects, said target cleavage is effected at a guide RNA concentration of 125 nM. In some aspects, said target cleavage is effected at a temperature of about 25° C. In some aspects, said target cleavage is effected at a temperature of about 37° C.

In various aspects, the present disclosure provides a composition comprising a first programmable nuclease population and a second programmable nuclease population, wherein the first programmable nuclease population and the second programmable nuclease population do not share a common PAM sequence.

In some aspects, the composition comprises a third programmable nuclease population, wherein none of the first programmable nuclease population, the second programmable nuclease population, and the third programmable nuclease population share a common PAM sequence. In some aspects, the composition comprises a fourth programmable nuclease population, wherein none of the first programmable nuclease population, the second programmable nuclease population, the third programmable nuclease population, and the programmable nuclease Cas12 population share a common PAM sequence. In some aspects, the first programmable nuclease, the second programmable nuclease, or a combination thereof comprises a Cas12 protein, a Cas13 protein, or a Cas14 protein. In some aspects, the third programmable nuclease comprises a Cas12 protein, a Cas13 protein, or a Cas14 protein. In some aspects, the fourth programmable nuclease comprises a Cas12 protein, a Cas13 protein, or a Cas14 protein.

In various aspects, the present disclosure provides a method for cleaving a unique site of a nucleic acid molecule, comprising designing a guide nucleic acid to cleave the unique site of the nucleic acid molecule and contacting the guide nucleic acid to a programmable nuclease and to the unique site of the nucleic acid molecule, thereby cleaving the unique site of the nucleic acid molecule.

In some aspects, a PAM sequence is not considered in the designing of the guide nucleic acid. In some aspects, the programmable nuclease comprises a Cas protein. In some aspects, the Cas protein is Cas14.

In various aspects, the present disclosure provides a method of sequence specific cleavage of a nucleic acid molecule in a sample comprising contacting to a first PAM independent nuclease to a flank on one side of a cleavage site the nucleic acid molecule and a second PAM independent nuclease to a flank on the other side of the cleavage site of the nucleic acid molecule.

In some aspects, the method further comprises contacting the sample to a DNA fragment for sequence specific break repair. In some aspects, the PAM independent nuclease is a Cas protein. In some aspects, the Cas protein is a nickase. In some aspects, the Cas protein is Cas14.

In various aspects, the present disclosure provides a method of detecting a presence or an absence of a target nucleic acid in a sample, the method comprising: contacting a first volume to a second volume, wherein the first volume comprises the sample and the second volume comprises: i) a guide nucleic acid having at least 10 nucleotides reverse complementary to a target nucleic acid in the sample; and ii) a programmable nuclease activated upon binding of the guide nucleic acid to the target nucleic acid; iii) a reporter comprising a nucleic acid and a detection moiety, wherein the second volume is at least 4-fold greater than the first volume; and detecting the presence or the absence of the target nucleic acid by measuring a signal produced by cleavage of the nucleic acid of the reporter, wherein cleavage occurs when the programmable nuclease is activated.

In some aspects, the first volume comprises from 1 µL to 10 µL. In some aspects, the first volume comprises from 1 µL to 5 µL. In some aspects, the first volume comprises about 2 µL. In some aspects, the first volume comprises about 4 µL. In some aspects, the second volume comprises from 5 µL to 40 µL. In some aspects, the second volume comprises from 10 µL to 30 µL. In some aspects, the second volume comprises about 20 µL. In some aspects, the second volume comprises about 30 µL.

In some aspects, the sample first volume comprises a buffer for cell lysis, a buffer for amplification, a primer, a polymerase, target nucleic acid, a non-target nucleic acid, a single-stranded DNA, a double-stranded DNA, a salt, a buffering agent, an NTP, a dNTP, or any combination thereof. In some aspects, the sample is a biological sample comprising blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue.

In some aspects, the programmable nuclease is a programmable Type V CRISPR/Cas enzyme. In some aspects, the programmable Type V CRISPR/Cas enzyme is a programmable Cas12 nuclease. In some aspects, the programmable Cas12 nuclease is Cas12a, Cas12b, Cas12c, Cas12d, or Cas12e. In some aspects, the programmable Type V CRISPR/Cas enzyme is a programmable Cas14 nuclease. In some aspects, the programmable Cas14 nuclease is Cas14a, Cas14b, Cas14c, Cas14d, Cas14e, Cas14f, Cas14g, or Cas14h. In some aspects, the programmable nuclease is a programmable Type VI CRISPR/Cas enzyme. In some aspects, the programmable Type VI CRISPR/Cas enzyme is a programmable Cas13 nuclease. In some aspects, the programmable Cas13 nuclease is Cas13a, Cas13b, Cas13c, Cas13d, or Cas13e.

In various aspects, the present disclosure provides a method of designing a plurality of primers for amplification of a target nucleic acid, the method comprising: providing a target nucleic acid, herein a guide nucleic acid hybridizes to the target nucleic acid and wherein at least 60% of a sequence of the target nucleic acid is between an F1c region and a B1 region or between an F1 and a B1c region; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region.

In various aspects, the present disclosure provides a method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the guide nucleic acid hybridizes to the target nucleic acid and wherein at least 60% of a sequence of the target nucleic acid is between the F1c region and a B1 region or between an F1 region and the B1c region; a reporter; and a programmable nuclease that cleaves the reporter when complexed with the guide nucleic acid; and measuring a detectable signal produced by cleavage of the reporter, wherein the measuring provides for detection of the target nucleic acid in the sample.

In some aspects, the sequence between the F1c region and the B1 region or the sequence between the B1c region and the F1 region is at least 50% reverse complementary to the guide nucleic acid sequence. In some aspects, the guide nucleic acid sequence is reverse complementary to no more than 50% of the forward inner primer, the backward inner primer, or a combination thereof. In some aspects, the guide nucleic acid does not hybridize to the forward inner primer and the backward inner primer.

In some aspects, a protospacer adjacent motif (PAM) or a protospacer flanking site (PFS) is 3' of the target nucleic acid. In some aspects, a protospacer adjacent motif (PAM) or a protospacer flanking site (PFS) is 3' of the B1 region and 5' of the F1c region or the protospacer adjacent motif (PAM) or a protospacer flanking site (PFS) is 3' of the F1 region and 5' of the B1c region. In some aspects, the 3' end of the target nucleic acid is 5' of the 5' end of the F3c region or the 3' end of the target nucleic acid is 5' of the 5' end of the B3c region. In some aspects, the 3' end of the target nucleic acid is 5' of the 5' end of the F2c region or 3' end of the target nucleic acid is 5' of the 5' end of the B2c region. In some aspects, the target nucleic acid is between the F1c region and the B1 region and the 3' end of the target nucleic acid is 5' of the 3' end of the F2c region, or wherein the target nucleic acid is between the B1c region and the F1 region and the 3' end of the target nucleic acid is 5' of the 3' end of the B2c region.

In some aspects, the guide nucleic acid has a sequence reverse complementary to no more than 50% of the forward inner primer, the backward inner primer, the forward outer primer, the backward outer primer, or any combination thereof. In some aspects, the guide nucleic acid sequence does not hybridize to the forward inner primer, the backward inner primer, the forward outer primer, the backward outer primer, or any combination thereof.

In some aspects, the guide nucleic acid sequence has a sequence reverse complementary to no more than 50% of a sequence of an F3c region, an F2c region, the F1c region, the B1c region, an B2c region, an B3c region, or any combination thereof. In some aspects, the guide nucleic acid sequence does not hybridize to a sequence of an F3c region, an F2c region, the F1c region, the B1c region, an B2c region, an B3c region, or any combination thereof.

In various aspects, the present disclosure provides a method of designing a plurality of primer for amplification of a target nucleic acid, the method comprising: providing the target nucleic acid comprising a sequence between a B2 region and a B1 region or between an F2 region and an F1 region that hybridizes to a guide nucleic acid; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region.

In various aspects, the present disclosure provides a method of designing a plurality of primer for amplification of a target nucleic acid, the method comprising: providing the target nucleic acid comprising a sequence between a F1c region and an F2c region or between a B1c region and a B2c region that hybridizes to a guide nucleic acid; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region.

In various aspects, the present disclosure provides a method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the target nucleic acid comprises a sequence between a B2 region and a B1 region or between the F2 region and an F1 region that hybridizes to the guide nucleic acid; a reporter; and a programmable nuclease that cleaves the reporter when complexed with the guide nucleic acid; and measuring a detectable signal produced by cleavage of the reporter, wherein the measuring provides for detection of the target nucleic acid in the sample.

In various aspects, the present disclosure provides a method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the target nucleic acid comprises a sequence between the F1c region and an F2c region or between the B1c region and a B2c region that hybridizes to the guide nucleic acid; a reporter; and a programmable nuclease that cleaves the reporter when complexed with the guide nucleic acid; and measuring a detectable signal produced by cleavage of the reporter, wherein the measuring provides for detection of the target nucleic acid in the sample.

In some aspects, a protospacer adjacent motif (PAM) or a protospacer flanking site (PFS) is 3' of the B2 region and 5' of the B1 region or the protospacer adjacent motif (PAM) or a protospacer flanking site (PFS) is 3' of the F2 region and 5' of the F1 region. In some aspects, a protospacer adjacent motif (PAM) or a protospacer flanking site (PFS) is 3' of the B1c region and 5' of the B2c region or the protospacer adjacent motif (PAM) or a protospacer flanking site (PFS) is 3' of the F1c region and 5' of the F2c region.

In some aspects, a protospacer adjacent motif (PAM) or a protospacer flanking site (PFS) is 3' of the target nucleic acid. In some aspects, the PAM and the PFS are 5' of the 5' end of the F1c region, 5' of the 5' end of the B1c region, 3' of the 3' end of the F3 region, 3' of the 3' end of the B3 region, 3' of the 3' end of the F2 region, 3' of the 3' end of the B2 region, or any combination thereof.

In some aspects, the PAM and the PFS do not overlap the F2 region, the B3 region, the F1c region, the F2 region, the B1c region, the B2 region, or any combination thereof. In some aspects, the PAM and the PFS do not hybridize to the forward inner primer, the backward inner primer, the forward outer primer, the backward outer primer, or any combination thereof.

In some aspects, the plurality of primers further comprises a loop forward primer. In some aspects, the plurality of primers further comprises a loop backward primer. In some aspects, the loop forward primer is between an F1c region and an F2c region. In some aspects, the loop backward primer is between a B1c region and a B2c region.

In some aspects, the target nucleic acid comprises a single nucleotide polymorphism (SNP). In some aspects, the single nucleotide polymorphism (SNP) comprises a HERC2 SNP. In some aspects, the single nucleotide polymorphism (SNP) is associated with an increased risk or decreased risk of cancer. In some aspects, the target nucleic acid comprises a single nucleotide polymorphism (SNP), and wherein the detectable signal is higher in the presence of a guide nucleic acid that is 100% complementary to the target nucleic acid comprising the single nucleotide polymorphism (SNP) than in the presence of a guide nucleic acid that is less than 100% complementary to the target nucleic acid comprising the single nucleotide polymorphism (SNP).

In some aspects, the plurality of primers and the guide nucleic acid are present together in a sample comprising the target nucleic acid. In some aspects, the contacting the sample to the plurality of primers results in amplifying the target nucleic acid. In some aspects, the amplifying and the contacting the sample to the guide nucleic acid occurs at the same time. In other aspects, the amplifying and the contacting the sample to the guide nucleic acid occur at different times. In some aspects, the method further comprises providing a polymerase, a dATP, a dTTP, a dGTP, a dCTP, or any combination thereof.

The present disclosure provides methods of detecting a target nucleic acid using a programmable nuclease.

In some aspects, the present disclosure provides a method of assaying for a target nucleic acid in a sample, comprising: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. Often, the target nucleic acid is from 0.05% to 20% of total nucleic acids in the sample. Various strategies, such as amplifying the target nucleic to insert a PAM sequence, COLD-PCR, allele-specific PCR, targeting the nucleic acid with a protein, or targeting other nucleic acids with protein can be used to enrich for the target nucleic acid in the sample. Additionally, a buffer comprising NaCl and heparin enhances the specificity of the programmable nuclease in the methods provided herein.

In various aspects, the present disclosure provides a method of assaying for a target nucleic acid in a sample, comprising: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample.

In some aspects, the target nucleic acid is from 0.05% to 20% of total nucleic acids in the sample. In further aspects, the target nucleic acid is from 0.1% to 10% of total nucleic acids in the sample. In still further aspects, the target nucleic acid is from 0.1% to 5% of total nucleic acids in the sample. In some aspects, the contacting is performed in a buffer comprising heparin and NaCl. In further aspects, the NaCl is 100 mM NaCl. In some aspects, the heparin is 50 ug/ml heparin.

In some aspects, the sample comprises at least one nucleic acid comprising at least 80% sequence identity to the segment of the target nucleic acid. In further aspects, the sample comprises at least one nucleic acid comprising at least 90% sequence identity to the segment of the target nucleic acid. In still further aspects, the sample comprises at least one nucleic acid comprising at least 99% sequence identity to the segment of the target nucleic acid.

In some aspects, the sample comprises at least one nucleic acid comprising less than 100% sequence identity to the segment of the target nucleic acid and no less than 50% sequence identity to the segment of the target nucleic acid. In some aspects, the sample comprises at least one nucleic acid comprising less than 100% sequence identity to the segment of the target nucleic acid and no less than 80% sequence identity to the segment of the target nucleic acid. In some aspects, the sample comprises at least one nucleic acid comprising less than 100% sequence identity to the segment of the target nucleic acid and no less than 90% sequence identity to the segment of the target nucleic acid.

In some aspects, the target nucleic acid comprises a single nucleotide mutation. In further aspects, the segment of the target nucleic acid comprises a single nucleotide mutation. In some aspects, the single nucleotide mutation is a synonymous substitution or a nonsynonymous substitution. In some aspects, the nonsynonymous substitution is a missense substitution or a nonsense point mutation.

In other aspects, the target nucleic acid comprises a deletion. In further aspects, the segment of the target nucleic acid comprises a deletion. In some aspects, the deletion comprises a deletion of from 1 to 50 nucleotides. In some aspects, the deletion comprises a deletion of from 9 to 21 nucleotides.

In some aspects, the method further comprises amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product before the contacting. In some aspects, the primer is a forward primer comprising the sequence encoding the PAM and has 1-8 nucleotides from the 3' end of the sequence encoding the PAM. In some aspects, the primer is a forward primer comprising the sequence encoding the PAM and has 4 nucleotides from the 3' end of the sequence encoding the PAM.

In other aspects, the primer is a forward primer comprising the sequence encoding the PAM and has 5 nucleotides from the 3' end of the sequence encoding the PAM. In still other aspects, the primer is a forward primer comprising the sequence encoding the PAM and has 6 nucleotides from the 3' end of the sequence encoding the PAM.

In some aspects, the segment of the target nucleic acid comprises the single nucleotide mutation at 5-9 nucleotides downstream of the 5' end the segment of the target nucleic acid comprising the sequence the encoding the PAM. In some aspects, the segment of the target nucleic acid comprises the single nucleotide mutation at 6 nucleotides downstream of the 5' end the segment of the target nucleic acid comprising the sequence the encoding the PAM. In other aspects, the segment of the target nucleic acid comprises the single nucleotide mutation at 7 nucleotides downstream of the 5' end the segment of the target nucleic acid comprising the sequence the encoding the PAM. In still other aspects, the segment of the target nucleic acid comprises the single nucleotide mutation at 8 nucleotides downstream of the 5' end the segment of the target nucleic acid comprising the sequence the encoding the PAM.

In some aspects, the segment of the target nucleic acid comprises the deletion at 5-9 nucleotides downstream of the 5' end the segment of the target nucleic acid comprising the sequence the encoding the PAM. In some aspects, the segment of the target nucleic acid comprises the deletion at 6 nucleotides downstream of the 5' end the segment of the target nucleic acid comprising the sequence the encoding the PAM. In other aspects, the segment of the target nucleic acid comprises the deletion at 7 nucleotides downstream of the 5' end the segment of the target nucleic acid comprising the sequence the encoding the PAM. In still other aspects, the segment of the target nucleic acid comprises the deletion at 8 nucleotides downstream of the 5' end the segment of the target nucleic acid comprising the sequence the encoding the PAM.

In some aspects, the method further comprises amplifying the target nucleic acid before the contacting. In some aspects, the amplifying the target nucleic acid before the contacting comprises using a blocking primer. In some aspects, the blocking primer binds to a nucleic acid comprising encoding the wild type sequence of the target nucleic acid segment. In some aspects, the amplifying comprises COLD-PCR.

In further aspects, the COLD-PCR comprises full COLD-PCR. In some aspects, the COLD-PCR comprises fast COLD-PCR. In some aspects, the amplifying comprises fast COLD-PCR. In some aspects, the amplifying comprises allele-specific PCR. In some aspects, the amplifying further comprises COLD-PCR.

In some aspects, the method further comprises removing a nucleic acid comprising at least 50% sequence identity to the target nucleic acid by binding a protein to the nucleic acid before the contacting. In some aspects, the protein is an antibody. In some aspects, the protein is a programmable nuclease without endonuclease activity. In some aspects, the method further comprises binding a protein to the target nucleic acid to remove other nucleic acids of the sample. In some aspects, the other nucleic acids comprise a nucleic acid comprising at least 50% sequence identity to the target nucleic acid. In some aspects, the protein is attached to a surface. In some aspects, the removing of the other nucleic acids comprises washing away nucleic acids that are not bound to the protein. In some aspects, the protein is an antibody. In some aspects, the protein is a programmable nuclease without endonuclease activity.

In some aspects, the programmable nuclease is a target nucleic acid activated effector protein that exhibits sequence independent cleavage upon activation. In some aspects, the programmable nuclease is an RNA guided nuclease. In some aspects, the programmable nuclease comprises a Cas nuclease. In some aspects, the Cas nuclease is Cas13. In further aspects, the Cas13 is Cas13a, Cas13b, Cas13c, Cas13d, or Cas13e. In other aspects, the Cas nuclease is Cas12. In further aspects, the Cas12 is Cas12a, Cas12b, Cas12c, Cas12d, or Cas12e. In some aspects, the Cas nuclease is Cas14. In further aspects, the Cas14 is Cas14a, Cas14b, Cas14c, Cas14d, Cas14e, Cas14f, Cas14g, or Cas14h. In some aspects, the Cas nuclease is Csm1, Cas9, C2c4, C2c8, C2c5, C2c10, or C2c9.

In some aspects, the guide nucleic acid comprises a crRNA. In some aspects, the guide nucleic acid comprises a crRNA and a tracrRNA. In some aspects, cleavage of at least one detector nucleic acid yields a signal. In some aspects, cleavage of at least one detector nucleic acid activates a photoexcitable fluorophore. In some aspects, cleavage of at least one detector nucleic acid deactivates a photoexcitable fluorophore. In some aspects, the signal is present prior to detector nucleic acid cleavage. In some aspects, the signal is absent prior to detector nucleic acid cleavage.

In some aspects, the sample comprises blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. In some aspects, the single nucleotide mutation is a single nucleotide polymorphism.

In various aspects, the present disclosure provides a method, comprising: contacting a programmable nuclease comprising a polypeptide having endonuclease activity and a guide nucleic acid to a target nucleic acid in a buffer comprising heparin. In some aspects, the heparin is present at a concentration of from 1 to 100 ug/ml heparin. In further aspects, the heparin is present at a concentration of from 40 to 60 ug/ml heparin. In still further aspects, the heparin is present at a concentration 50 ug/ml heparin.

In some aspects, the buffer comprises NaCl. In further aspects, the NaCl is present at a concentration of from 1 to 200 mM NaCl. In still further aspects, the NaCl is present at a concentration of from 80 to 120 mM NaCl. In still further aspects, the NaCl is present at a concentration of 100 mM NaCl.

In some aspects, the target nucleic acid is a substrate target nucleic acid. In some aspects, the substrate nucleic acid comprises a cancer allele. In further aspects, the cancer allele is present at a low concentration relative to a wild type allele. In some aspects, the substrate target nucleic acid comprises a splice variant. In some aspects, the substrate target nucleic acid comprises an edited base. In some aspects, the substrate target nucleic acid comprises a bisulfite-treated base. In some aspects, the substrate target nucleic acid comprises a segment that is reverse complementary to a segment of the guide nucleic acid.

In various aspects, the present disclosure provides a method of designing a plurality of primers for amplification of a target nucleic acid, the method comprising: providing a target nucleic acid, herein a guide nucleic acid hybridizes to the target nucleic acid and wherein at least 60% of a sequence of the target nucleic acid is between an F1c region and a B1 region or between an F1 and a B1c region; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region.

In various aspects, the present disclosure provides a method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the guide nucleic acid hybridizes to the target nucleic acid and wherein at least 60% of a sequence of the target nucleic acid is between the F1c region and a B1 region or between an F1 region and the B1c region; a reporter; and a programmable nuclease that cleaves the reporter when complexed with the guide nucleic acid; and measuring a detectable signal produced by cleavage of the reporter, wherein the measuring provides for detection of the target nucleic acid in the sample.

In some aspects, the sequence between the F1c region and the B1 region or the sequence between the B1c region and the F1 region is at least 50% reverse complementary to the guide nucleic acid sequence. In some aspects, the guide nucleic acid sequence is reverse complementary to no more than 50% of the forward inner primer, the backward inner primer, or a combination thereof. In some aspects, the guide nucleic acid does not hybridize to the forward inner primer and the backward inner primer.

In some aspects, a protospacer adjacent motif (PAM) or a protospacer flanking site (PFS) is 3' of the target nucleic acid. In some aspects, a protospacer adjacent motif (PAM) or a protospacer flanking site (PFS) is 3' of the B1 region and 5' of the F1c region or the protospacer adjacent motif (PAM) or a protospacer flanking site (PFS) is 3' of the F1 region and 5' of the B1c region. In some aspects, the 3' end of the target nucleic acid is 5' of the 5' end of the F3c region or the 3' end of the target nucleic acid is 5' of the 5' end of the B3c region. In some aspects, the 3' end of the target nucleic acid is 5' of the 5' end of the F2c region or 3' end of the target nucleic acid is 5' of the 5' end of the B2c region. In some aspects, the target nucleic acid is between the F1c region and the B1 region and the 3' end of the target nucleic acid is 5' of the 3' end of the F2c region, or wherein the target nucleic acid is between the B1c region and the F1 region and the 3' end of the target nucleic acid is 5' of the 3' end of the B2c region.

In some aspects, the guide nucleic acid has a sequence reverse complementary to no more than 50% of the forward inner primer, the backward inner primer, the forward outer primer, the backward outer primer, or any combination thereof. In some aspects, the guide nucleic acid sequence does not hybridize to the forward inner primer, the backward inner primer, the forward outer primer, the backward outer primer, or any combination thereof.

In some aspects, the guide nucleic acid sequence has a sequence reverse complementary to no more than 50% of a sequence of an F3c region, an F2c region, the F1c region, the B1c region, an B2c region, an B3c region, or any combination thereof. In some aspects, the guide nucleic acid sequence does not hybridize to a sequence of an F3c region, an F2c region, the F1c region, the B1c region, an B2c region, an B3c region, or any combination thereof.

In various aspects, the present disclosure provides a method of designing a plurality of primer for amplification of a target nucleic acid, the method comprising: providing the target nucleic acid comprising a sequence between a B2 region and a B1 region or between an F2 region and an F1 region that hybridizes to a guide nucleic acid; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region.

In various aspects, the present disclosure provides a method of designing a plurality of primer for amplification of a target nucleic acid, the method comprising: providing the target nucleic acid comprising a sequence between a F1c region and an F2c region or between a B1c region and a B2c region that hybridizes to a guide nucleic acid; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region.

In various aspects, the present disclosure provides a method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the target nucleic acid comprises a sequence between a B2 region and a B1 region or between the F2 region and an F1 region that hybridizes to the guide nucleic acid; a reporter; and a programmable nuclease that cleaves the reporter when complexed with the guide nucleic acid; and measuring a detectable signal produced by cleavage of the reporter, wherein the measuring provides for detection of the target nucleic acid in the sample.

In various aspects, the present disclosure provides a method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the target nucleic acid comprises a sequence between the F1c region and an F2c region or between the B1c region and a B2c region that hybridizes to the guide nucleic acid; a reporter; and a programmable nuclease that cleaves the reporter when complexed with the guide nucleic acid; and measuring a detectable signal produced by cleavage of the reporter, wherein the measuring provides for detection of the target nucleic acid in the sample.

In some aspects, a protospacer adjacent motif (PAM) or a protospacer flanking site (PFS) is 3' of the B2 region and 5' of the B1 region or the protospacer adjacent motif (PAM) or a protospacer flanking site (PFS) is 3' of the F2 region and 5' of the F1 region. In some aspects, a protospacer adjacent motif (PAM) or a protospacer flanking site (PFS) is 3' of the B1c region and 5' of the B2c region or the protospacer adjacent motif (PAM) or a protospacer flanking site (PFS) is 3' of the F1c region and 5' of the F2c region.

In some aspects, a protospacer adjacent motif (PAM) or a protospacer flanking site (PFS) is 3' of the target nucleic acid. In some aspects, the PAM and the PFS are 5' of the 5' end of the F1c region, 5' of the 5' end of the B1c region, 3' of the 3' end of the F3 region, 3' of the 3' end of the B3 region, 3' of the 3' end of the F2 region, 3' of the 3' end of the B2 region, or any combination thereof.

In some aspects, the PAM and the PFS do not overlap the F2 region, the B3 region, the F1c region, the F2 region, the B1c region, the B2 region, or any combination thereof. In some aspects, the PAM and the PFS do not hybridize to the forward inner primer, the backward inner primer, the forward outer primer, the backward outer primer, or any combination thereof.

In some aspects, the plurality of primers further comprises a loop forward primer. In some aspects, the plurality of primers further comprises a loop backward primer. In some aspects, the loop forward primer is between an F1c region and an F2c region. In some aspects, the loop backward primer is between a B1c region and a B2c region.

In some aspects, the target nucleic acid comprises a single nucleotide polymorphism (SNP). In some aspects, the single nucleotide polymorphism (SNP) comprises a HERC2 SNP. In some aspects, the single nucleotide polymorphism (SNP) is associated with an increased risk or decreased risk of cancer. In some aspects, the target nucleic acid comprises a single nucleotide polymorphism (SNP), and wherein the detectable signal is higher in the presence of a guide nucleic acid that is 100% complementary to the target nucleic acid comprising the single nucleotide polymorphism (SNP) than in the presence of a guide nucleic acid that is less than 100% complementary to the target nucleic acid comprising the single nucleotide polymorphism (SNP).

In some aspects, the plurality of primers and the guide nucleic acid are present together in a sample comprising the target nucleic acid. In some aspects, the amplifying and the contacting the sample to the guide nucleic acid occurs at the same time. In other aspects, the amplifying and the contacting the sample to the guide nucleic acid occur at different times. In some aspects, the method further comprises providing a polymerase, a dATP, a dTTP, a dGTP, a dCTP, or any combination thereof.

The present disclosure provides an amplification method for inserting a PAM sequence into a target nucleic acid.

In some aspects, the present disclosure provides a method of assaying for a target nucleic acid segment in a sample, wherein the target nucleic acid segment lacks a PAM sequence, comprising amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample. Often, the PAM comprises a sequence encoding dUdUdUN. Sometimes the PAM comprises a sequence encoding TTTN. The programmable nuclease is, for example, Cas12. The present disclosure further provides the number of nucleotides in a nucleotide extension of the forward primer used to produce the PAM target nucleic acid, as well as the location of the mutation or mismatch in the PAM target nucleic acid.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The patent or application file contains at least one drawing executed in color. Copies of this patent or patent application publication with color drawing(s) will be provided by the Office upon request and payment of the necessary fee. The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

599-SEQ ID NO: 602, and SEQ ID NO: 2 in the presence of various salt concentrations.

Figure 17A:
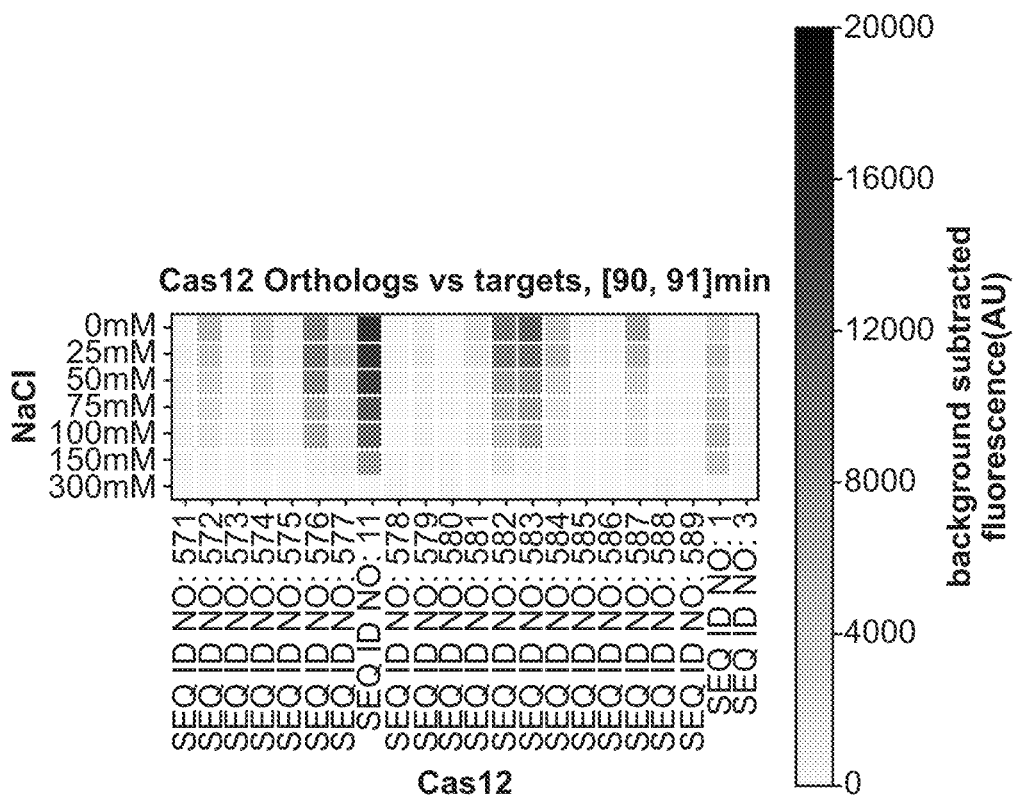
Figure 17B:
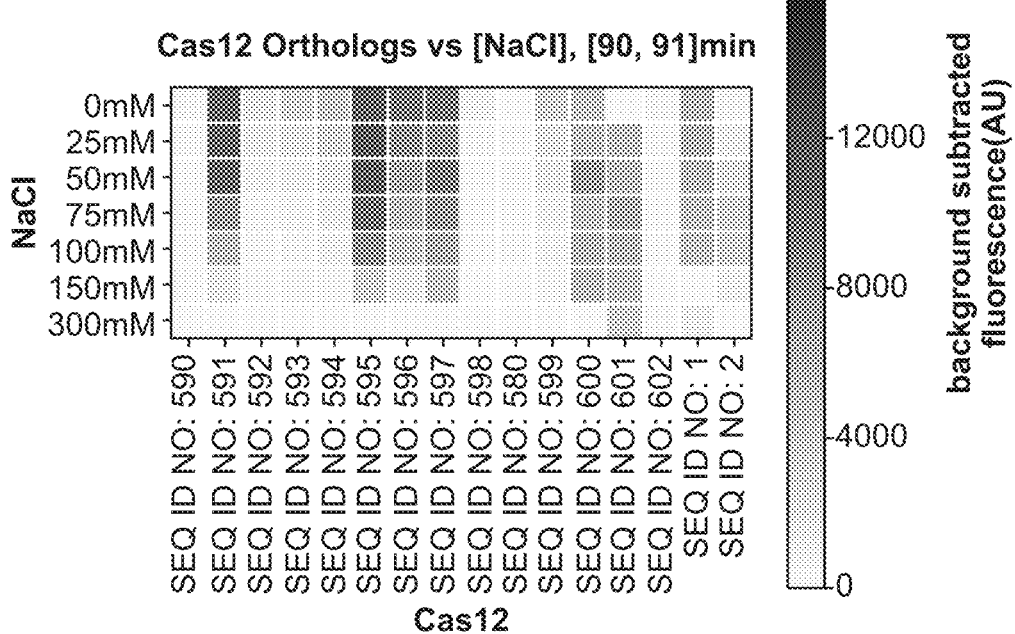

FIG. 17A and FIG. 17B show trans cleavage activity of various Cas12 orthologs corresponding to SEQ ID NO: 590-SEQ ID NO: 598, SEQ ID NO: 580, and SEQ ID NO: 599-SEQ ID NO: 602, and SEQ ID NO: 2 in the presence of various salt concentrations.

Figure 18:
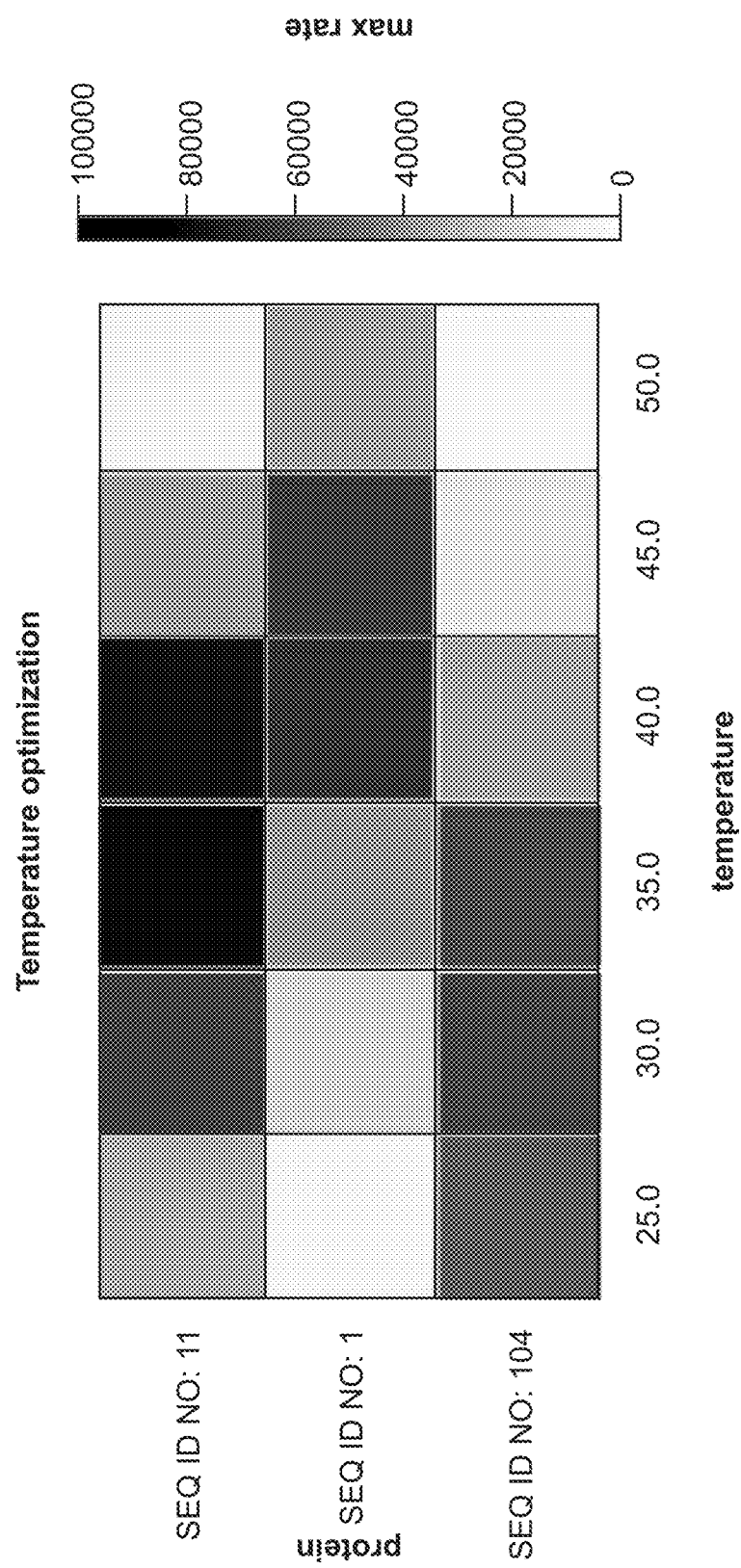

FIG. 18 shows activity of three programmable nucleases, a Cas12 variant (SEQ ID NO: 11), LbCas12a (SEQ ID NO: 1), and LbuCas13a (SEQ ID NO: 104, also referred to herein as Lbu C2C2). The results show that the functional range for the Cas12 variant (SEQ ID NO: 11) is between 25° C. and 45° C., with maximal activity at 35° C.

Figure 19:
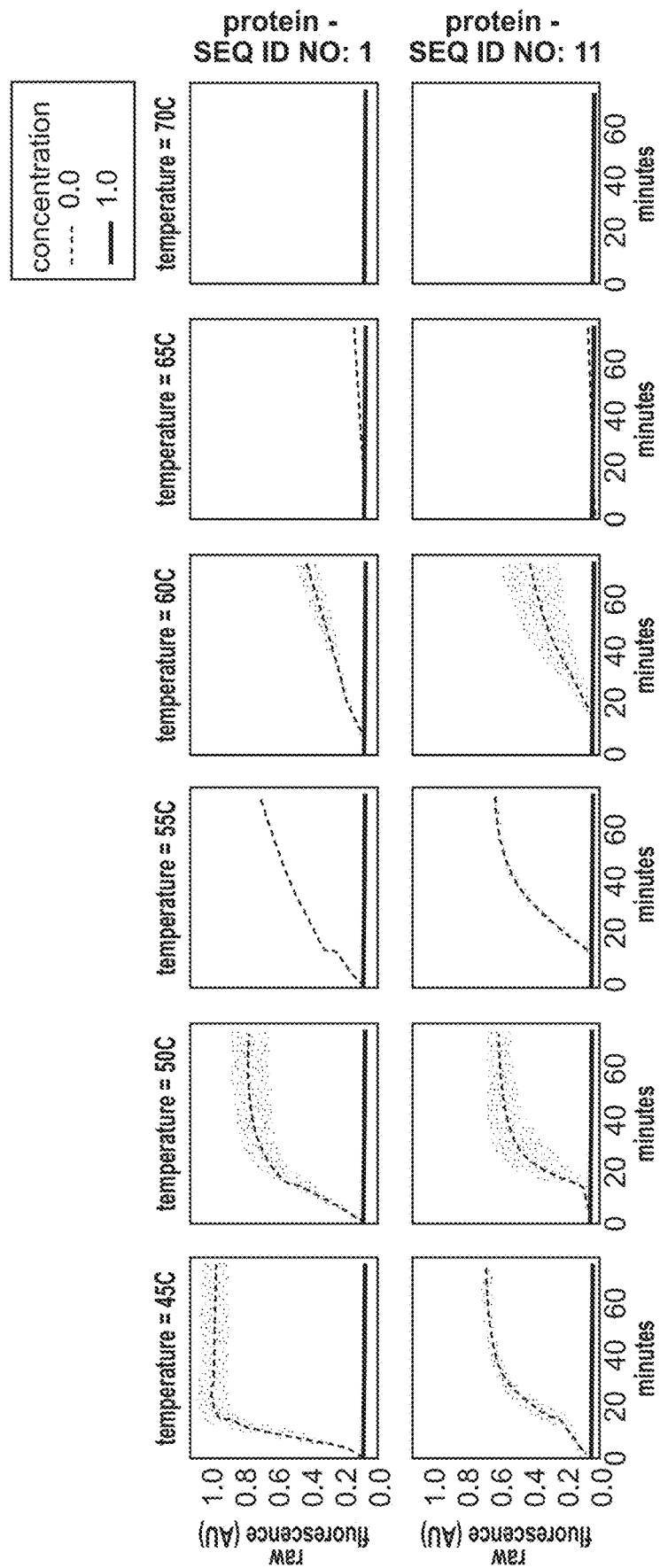

FIG. 19 shows the results of incubating two Cas12 proteins, SEQ ID NO: 1 and SEQ ID NO: 11, for 15 minutes at 45° C., 50° C., 55° C., 60° C., 65° C., or 70° C. and then decreasing the reaction temperature to 37° C.

Figure 20:
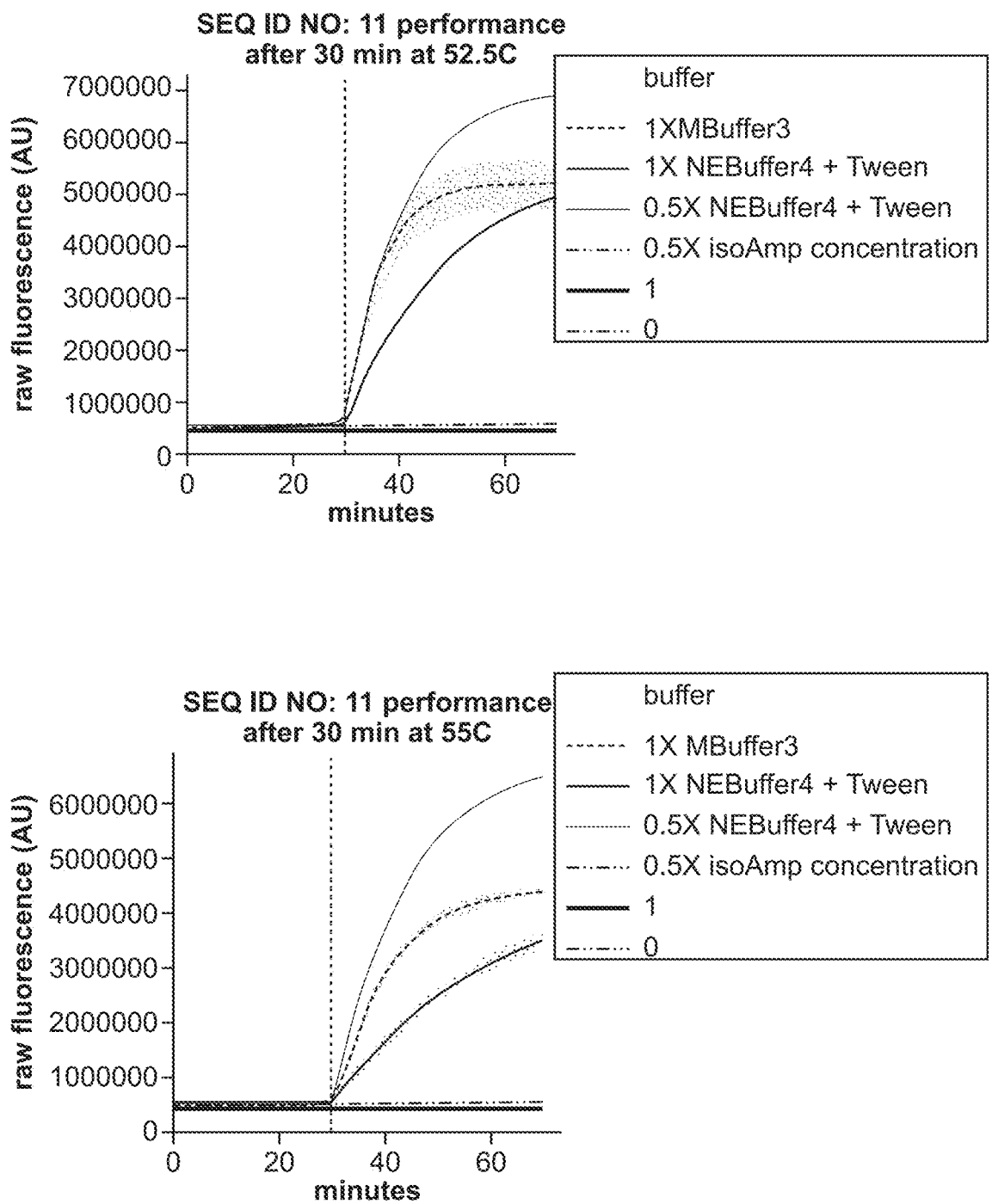

FIG. 20 shows that the stability of a Cas12 variant (SEQ ID NO: 11) at elevated temperatures is dependent on the buffer composition.

Figure 21:
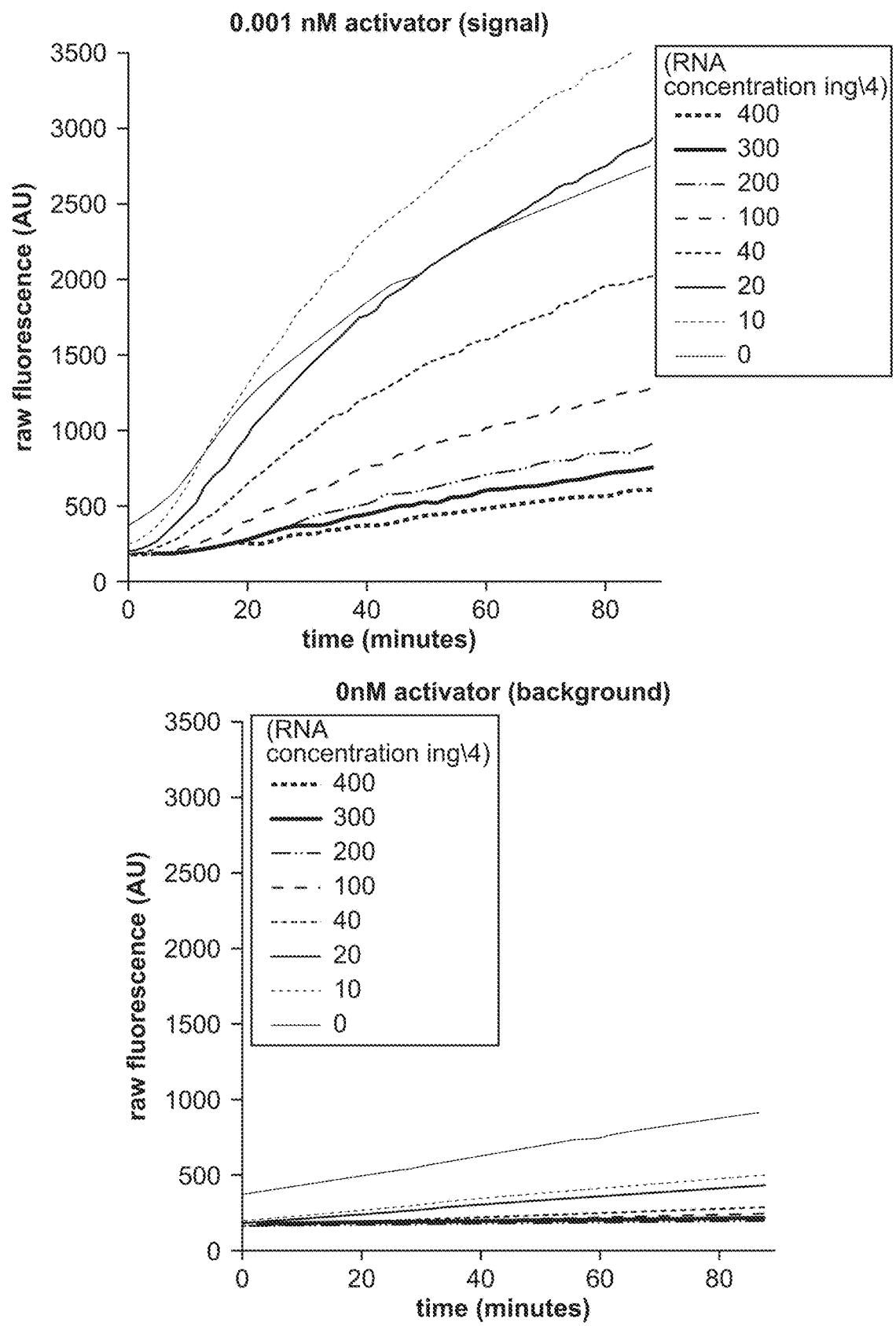

FIG. 21 shows graphs of activity of a Cas13 (SEQ ID NO: 104), as measured by fluorescence, with (left graph) and without (right graph) activator over time.

FIG. 22 shows inhibition of Cas13a (SEQ ID NO: 104) activity by SDS and urea.

Figure 22A:
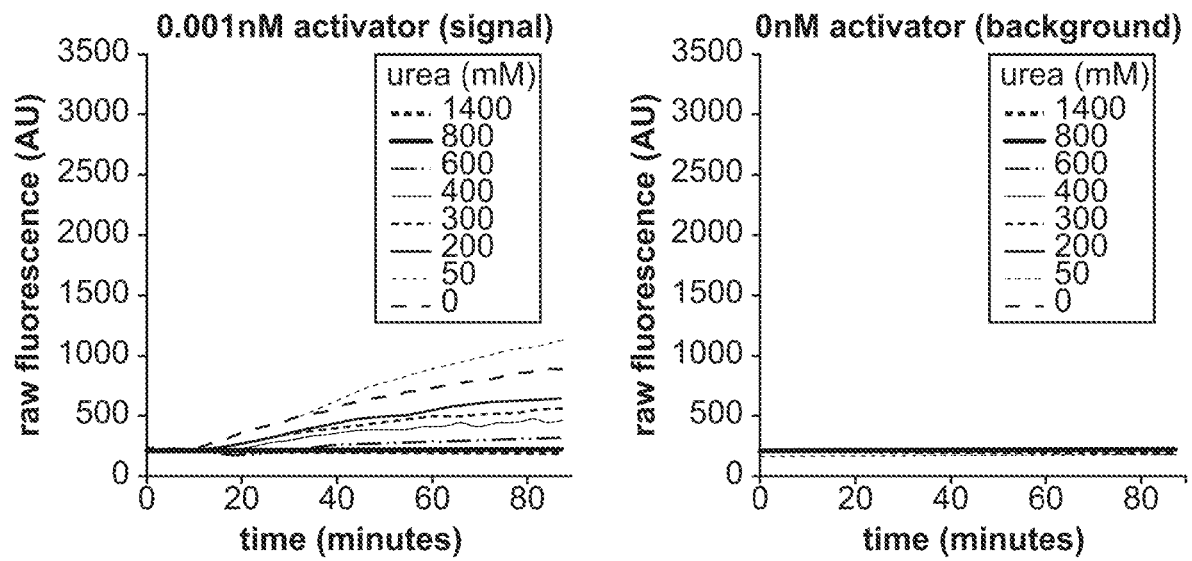

FIG. 22A shows the Cas13a (SEQ ID NO: 104) detection assay performed in the presence of 0-200 mM urea.

Figure 22B:
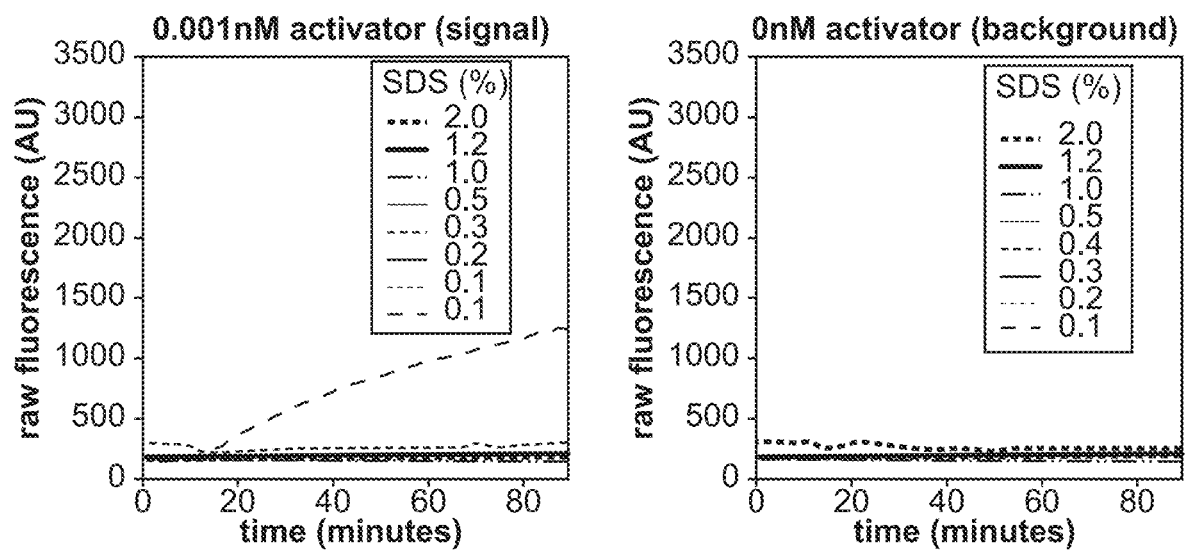

FIG. 22B shows complete inhibition of Cas13a (SEQ ID NO: 104) upon addition of 0.1% or greater amounts of SDS to the reaction (left graph shows with activator and right graph shows without activator).

FIG. 23 shows the performance of Cas13a (SEQ ID NO: 104) in DETECTR reactions with varying concentrations of salt.

Figure 23A:
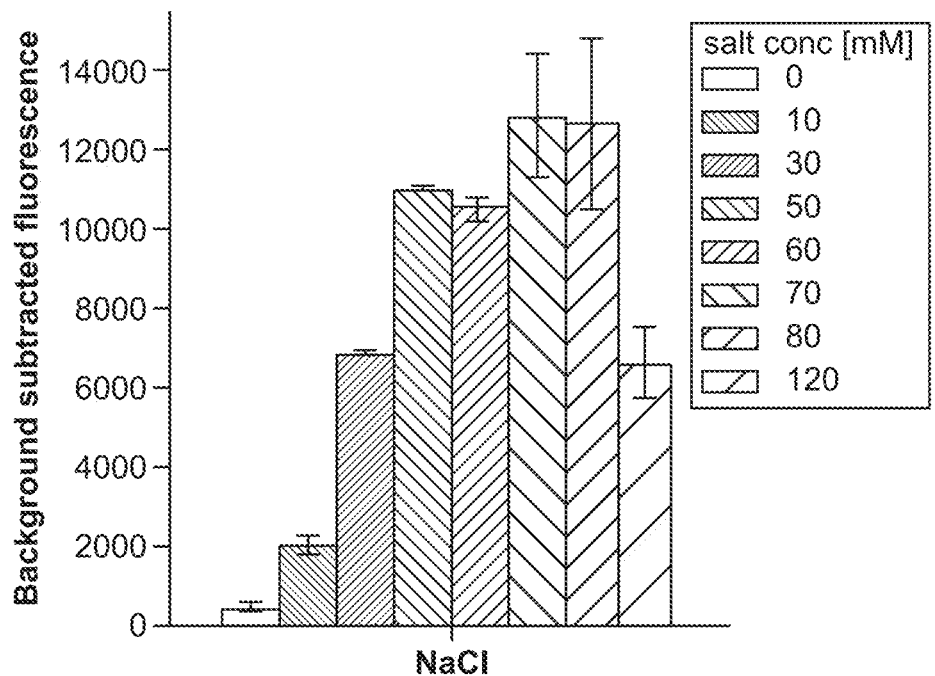

FIG. 23A shows the results of varying the concentration of NaCl in a Cas13a (SEQ ID NO: 104) DETECTR reaction.

Figure 23B:
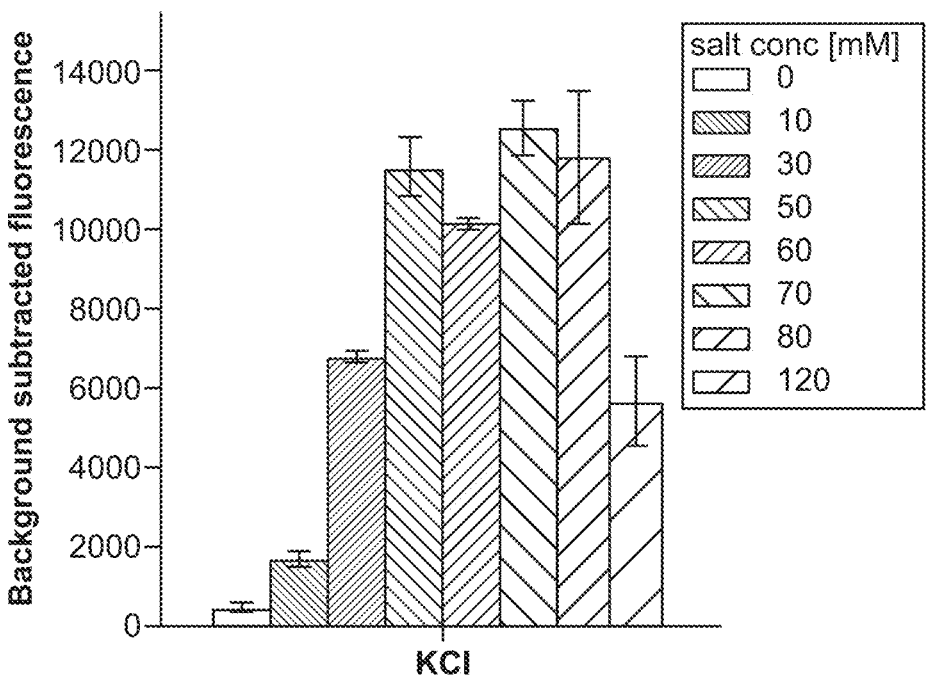

FIG. 23B shows the results of varying the concentration of KCl in a Cas13a (SEQ ID NO: 104) DETECTR reaction.

FIG. 24 shows optimization of DTT concentration in a Cas13a (SEQ ID NO: 104) DETECTR assay.

Figure 24A:
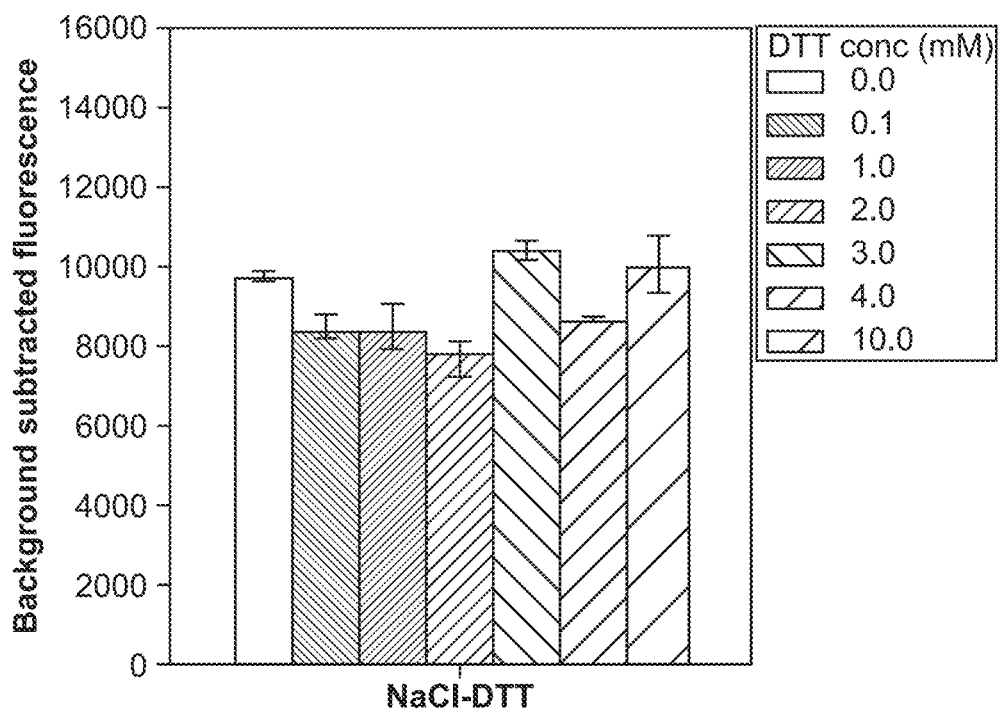

FIG. 24A shows activity of a Cas13a (SEQ ID NO: 104) at varying DTT concentration in NaCl.

Figure 24B:
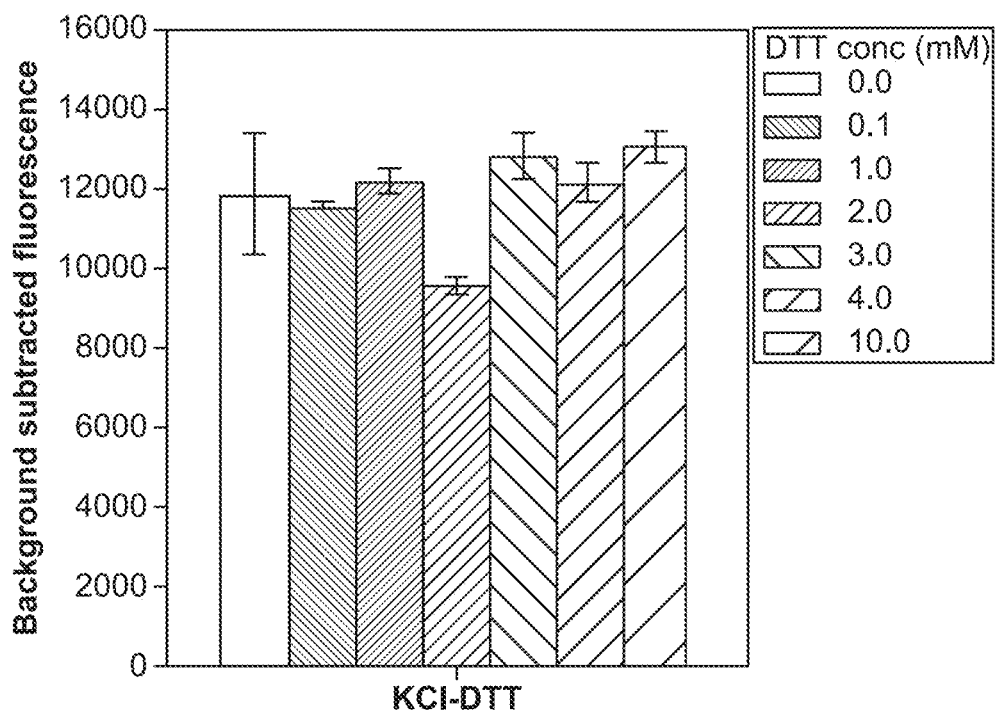

FIG. 24B shows activity of a Cas13a (SEQ ID NO: 104) at varying DTT concentrations in KCl. The orange bar indicates buffer conditions with 50 mM KCl and no DTT. In addition to the indicated KCl and DTT concentration, each buffer condition also contained 20 mM HEPES pH 6.8, 5 mM $MgCl_2$, 10 μg/mL BSA, 100 μg/mL tRNA, 0.01% Igepal Ca-630 (NP-40), and 5% Glycerol).

Figure 25:
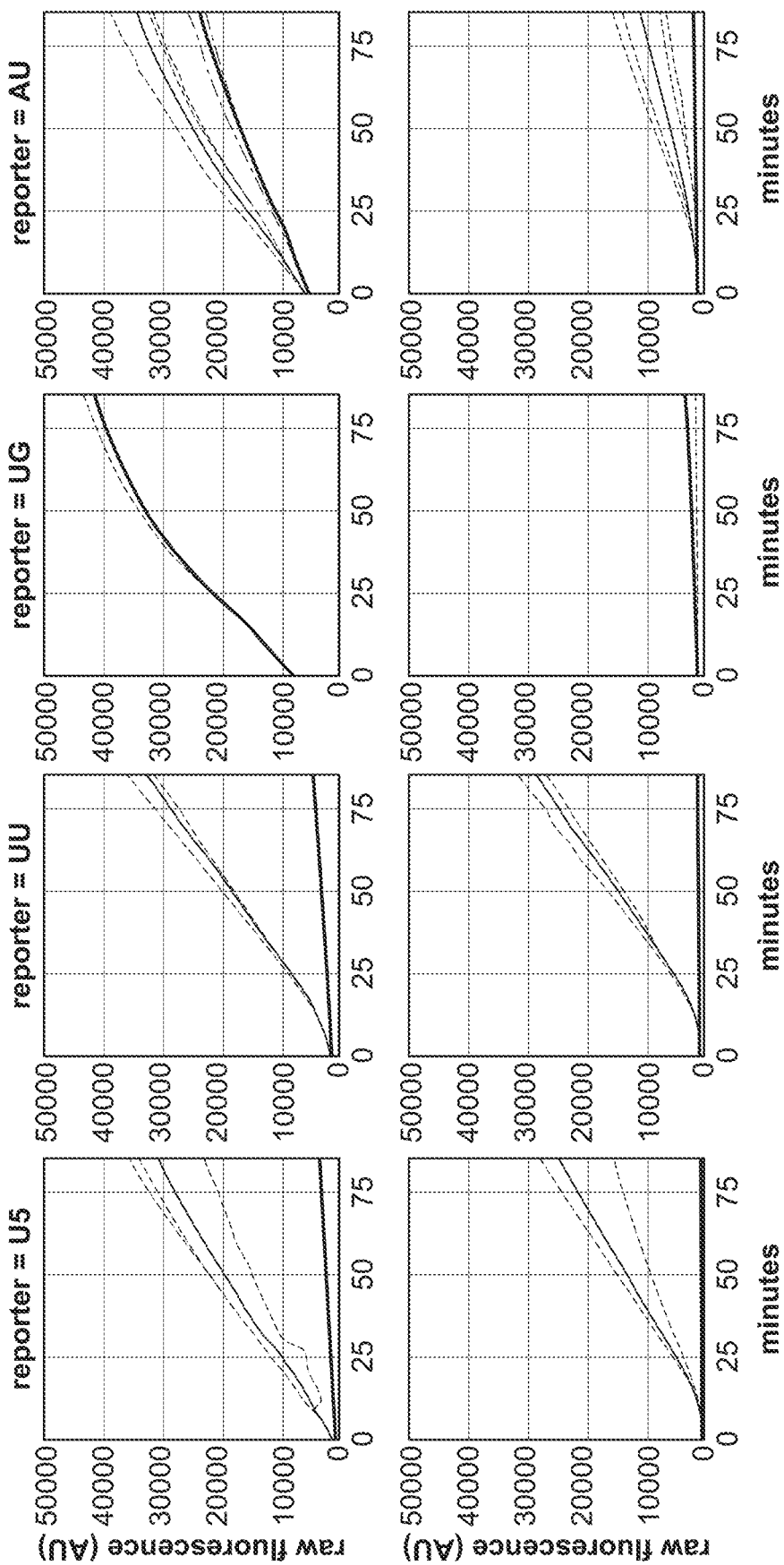
Figure 25:
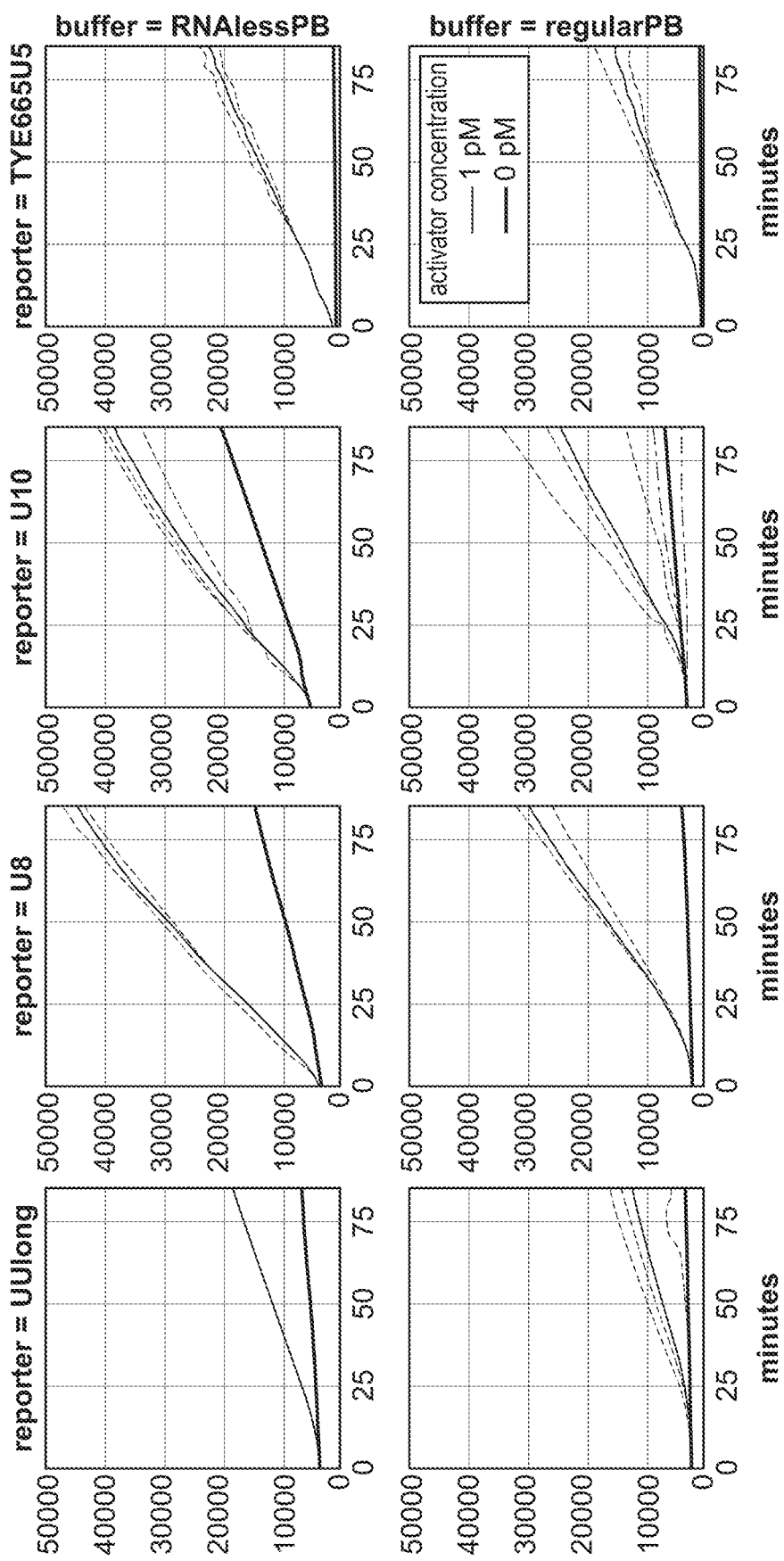

FIG. 25 shows the activity of Cas13a (SEQ ID NO: 104) in the DETECTR assay, as measured by fluorescence, for each of the tested reporters.

Figure 26:
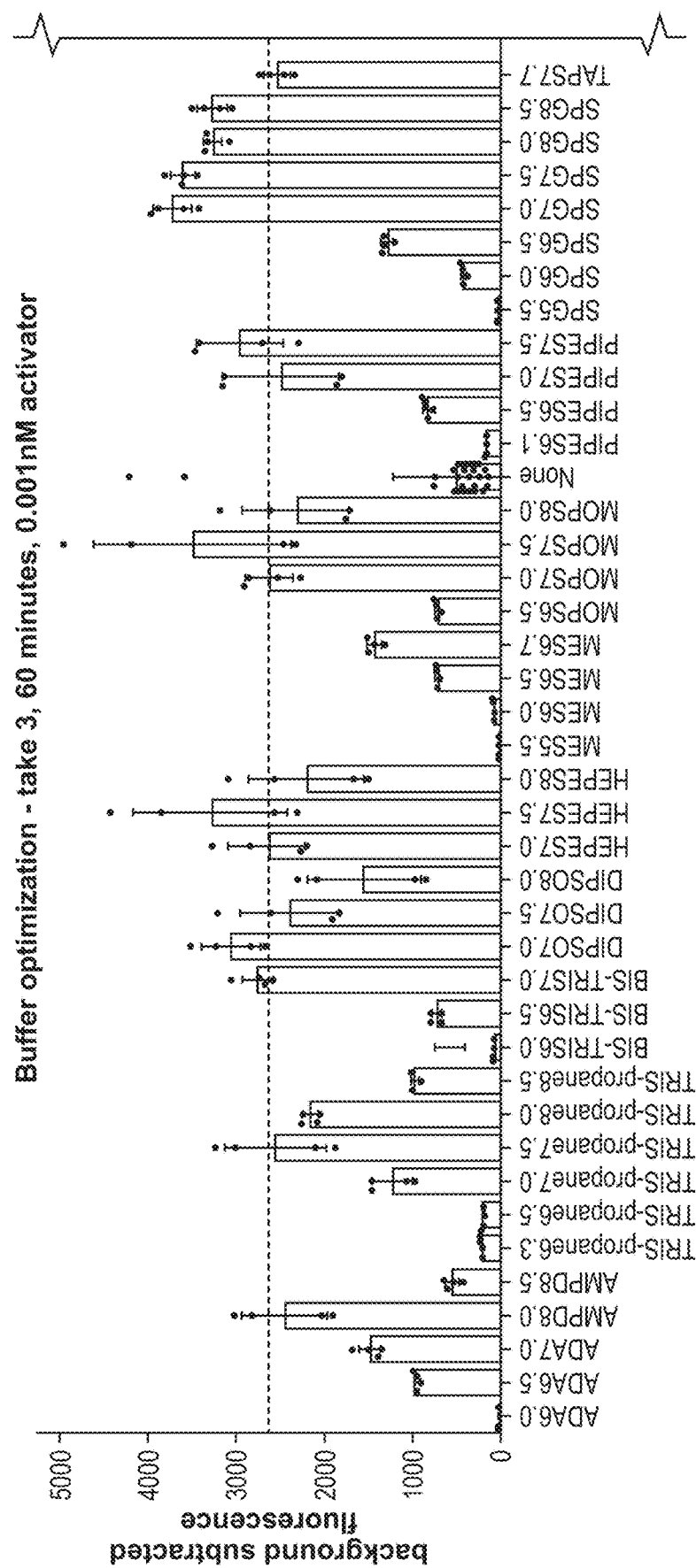
Figure 26:
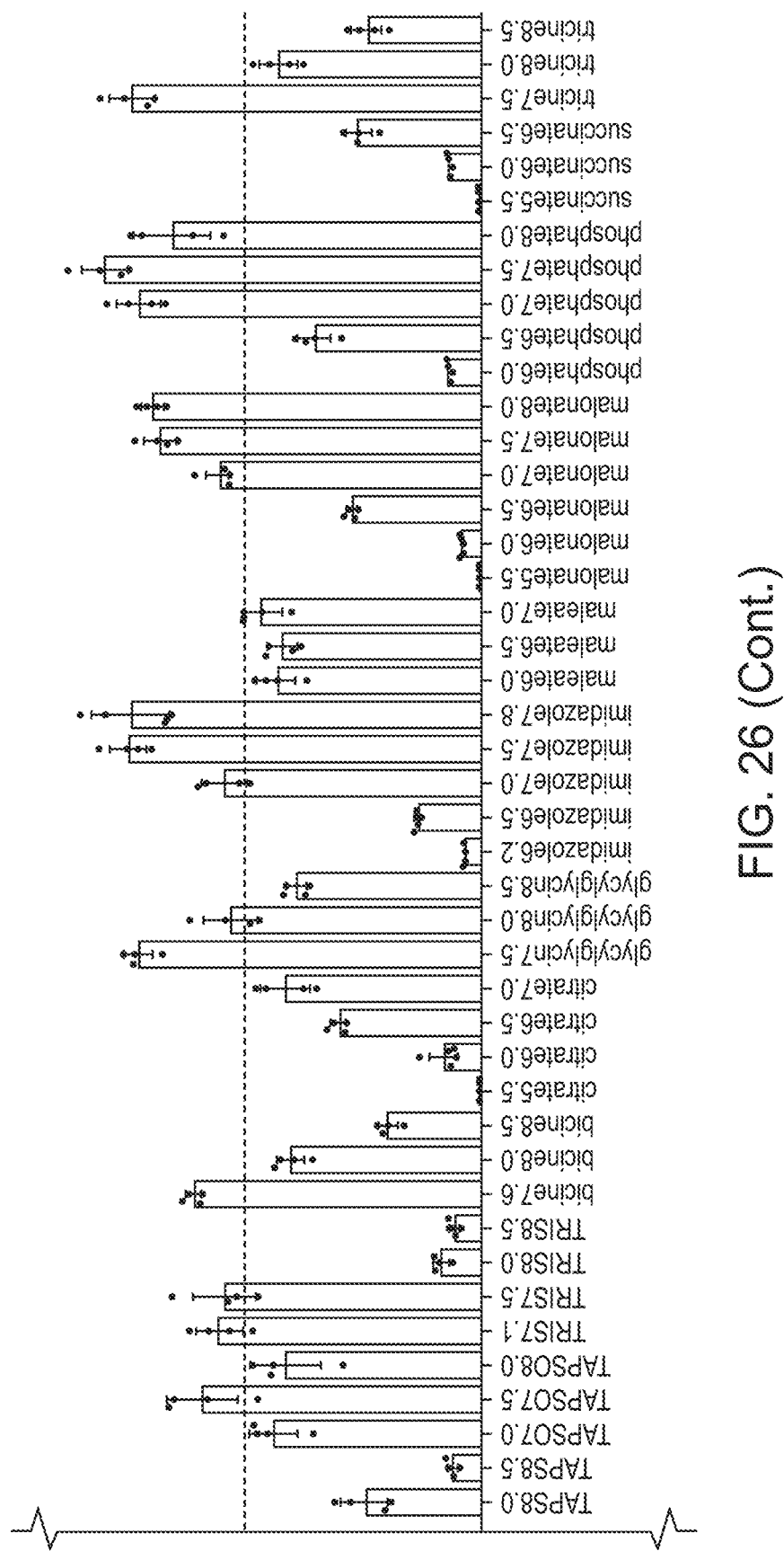

FIG. 26 shows Cas13a (SEQ ID NO: 104) activity in the DETECTR assay, as measured by fluorescence, for each of the tested conditions.

Figure 27:
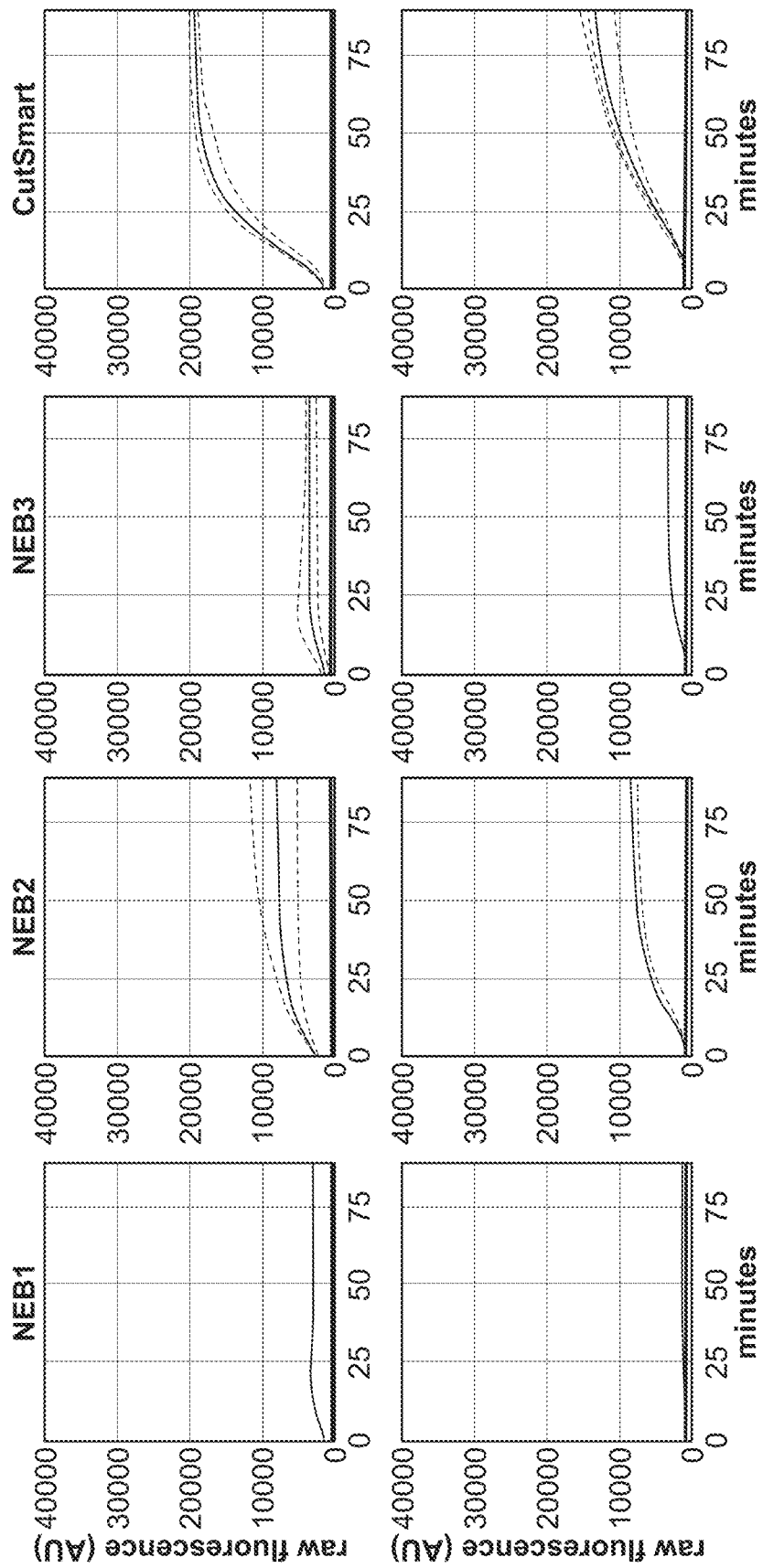
Figure 27:
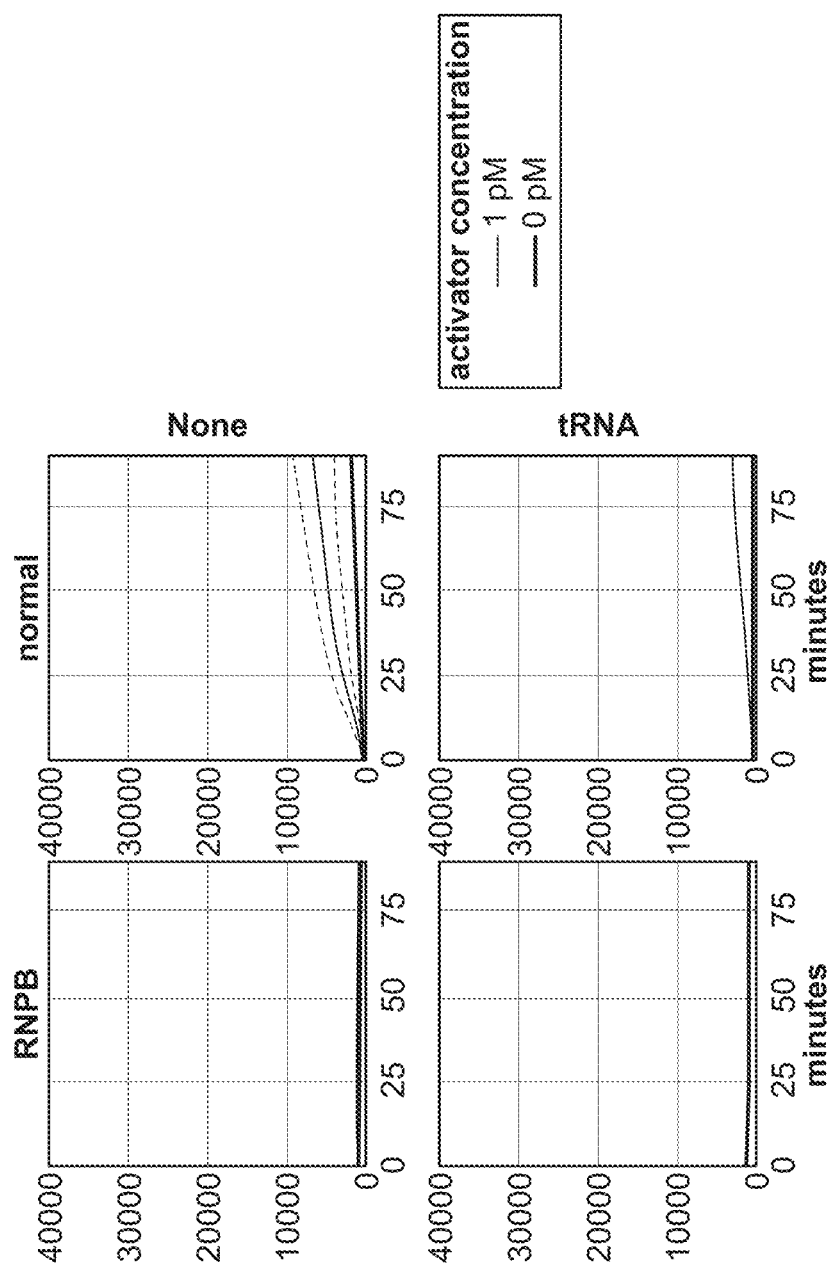

FIG. 27 shows Cas13a (SEQ ID NO: 104) performance in the DETECTR assay, as measured by fluorescence, for each of the five commercially available buffers and a HEPES pH 6.8 buffer ("Normal," 20 mM HEPES pH 6.8; 50 mM KCl; 5 mM $MgCl_2$; 10 μg/mL BSA; 100 μg/mL tRNA; 0.01% Igepal Ca-630 (NP-40); 5% Glycerol).

Figure 28:
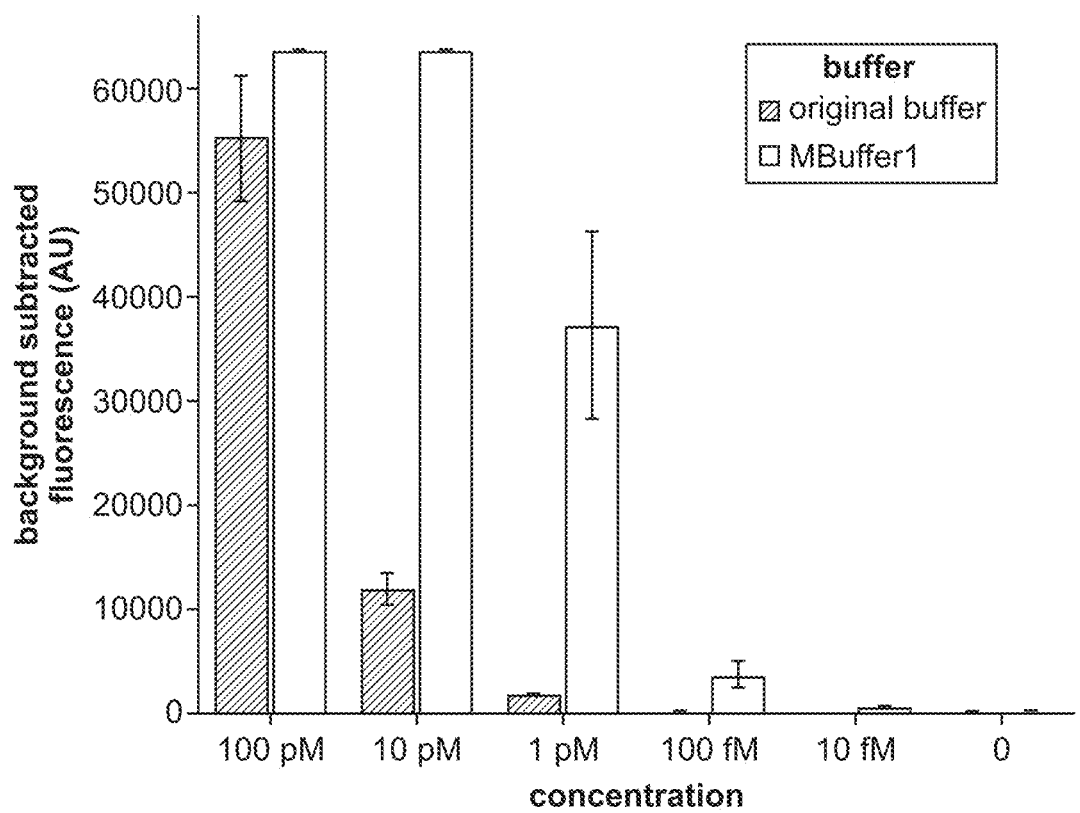

FIG. 28 shows a comparison of the a HEPES pH 6.8 buffer ("Original Buffer," 20 mM HEPES pH 6.8; 50 mM KCl; 5 mM $MgCl_2$; 10 μg/mL BSA; 100 μg/mL tRNA; 0.01% Igepal Ca-630 (NP-40); 5% Glycerol) to an high performance buffer ("MBuffer1," 20 mM imidazole pH 7.5, 50 mM KCl, 5 mM $MgCl_2$, 10 μg/μL BSA, 0.01% Igepal Ca-630, and 5% glycerol) for a Cas13a (SEQ ID NO: 104) DETECTR assay with serially diluted target RNAs and run at 37° C. for 30 minutes.

Figure 29:
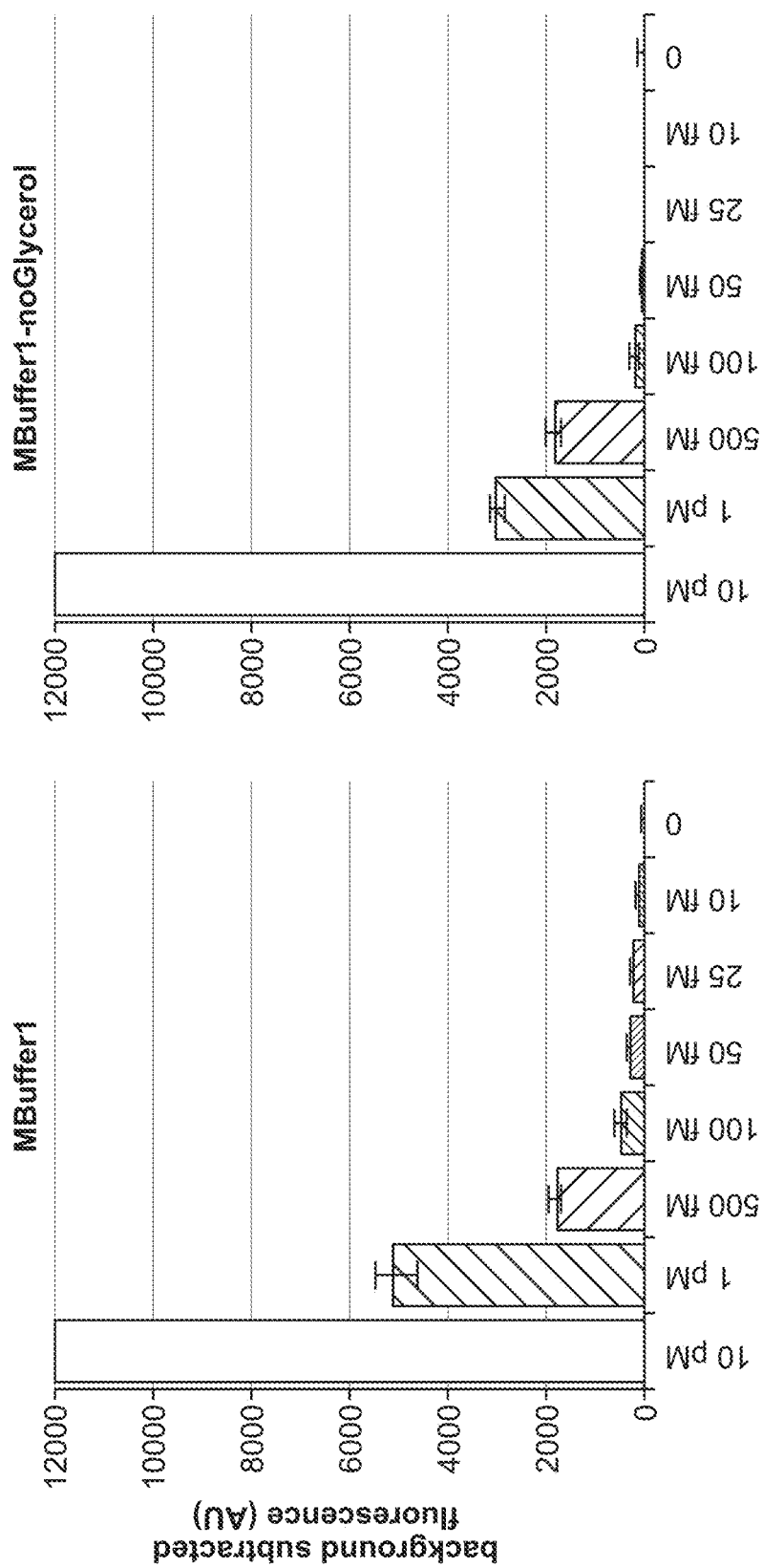

FIG. 29 shows that 5% glycerol in an high performance buffer ("MBuffer1," left graph, 20 mM imidazole pH 7.5, 50 mM KCl, 5 mM $MgCl_2$, 10 μg/μL BSA, 0.01% Igepal Ca-630, and 5% glycerol) increases performance of a Cas13a (SEQ ID NO: 104) DETECTR assay in comparison to an identical buffer without glycerol (right graph).

Figure 30:
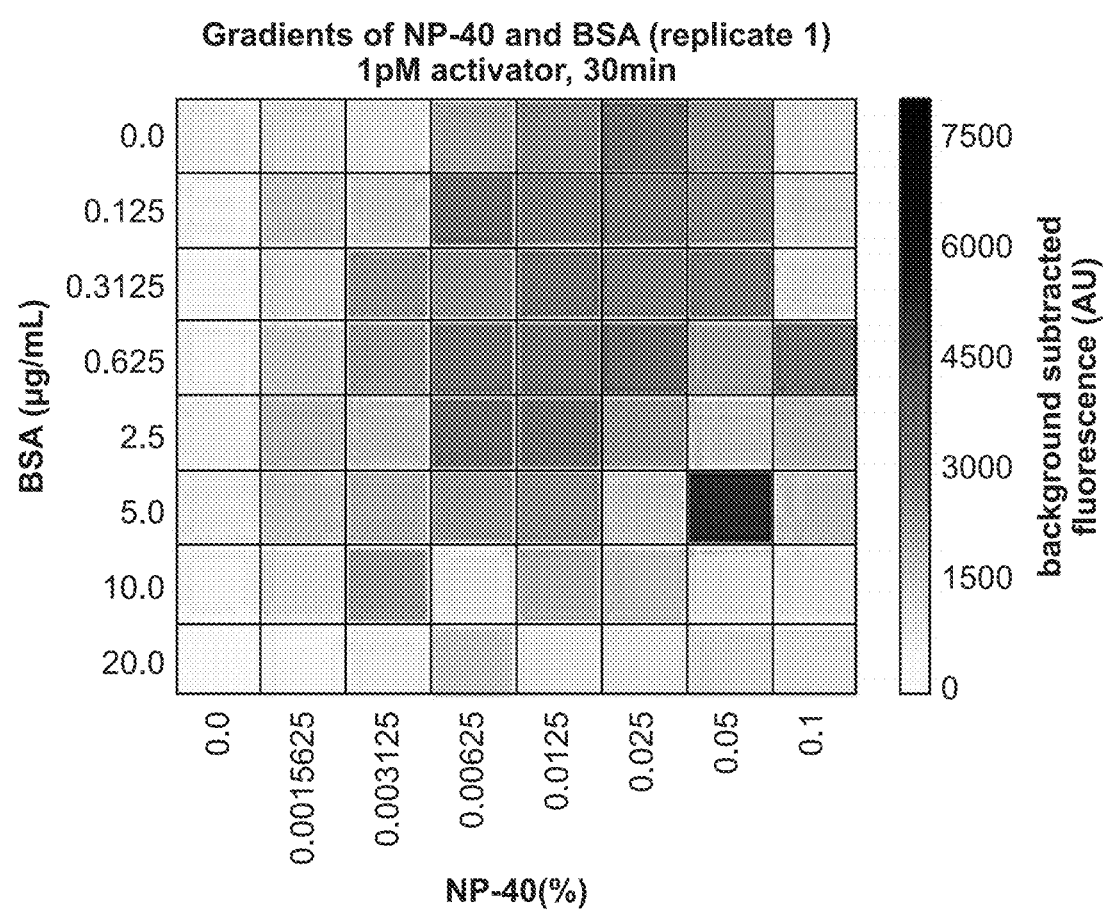

FIG. 30 shows a gradient chart of Cas13a (SEQ ID NO: 104) activity in the DETECTR assay, as measured by fluorescence, (darker squares indicate increased Cas13a activity) versus varying NP-40 concentration along the x-axis and varying BSA concentration along the y-axis. In addition to the indicated concentrations of NP-40 and BSA, each buffer contained 20 mM imidazole pH 7.5, 50 mM KCl, 5 mM $MgCl_2$, and 5% glycerol.

Figure 31:
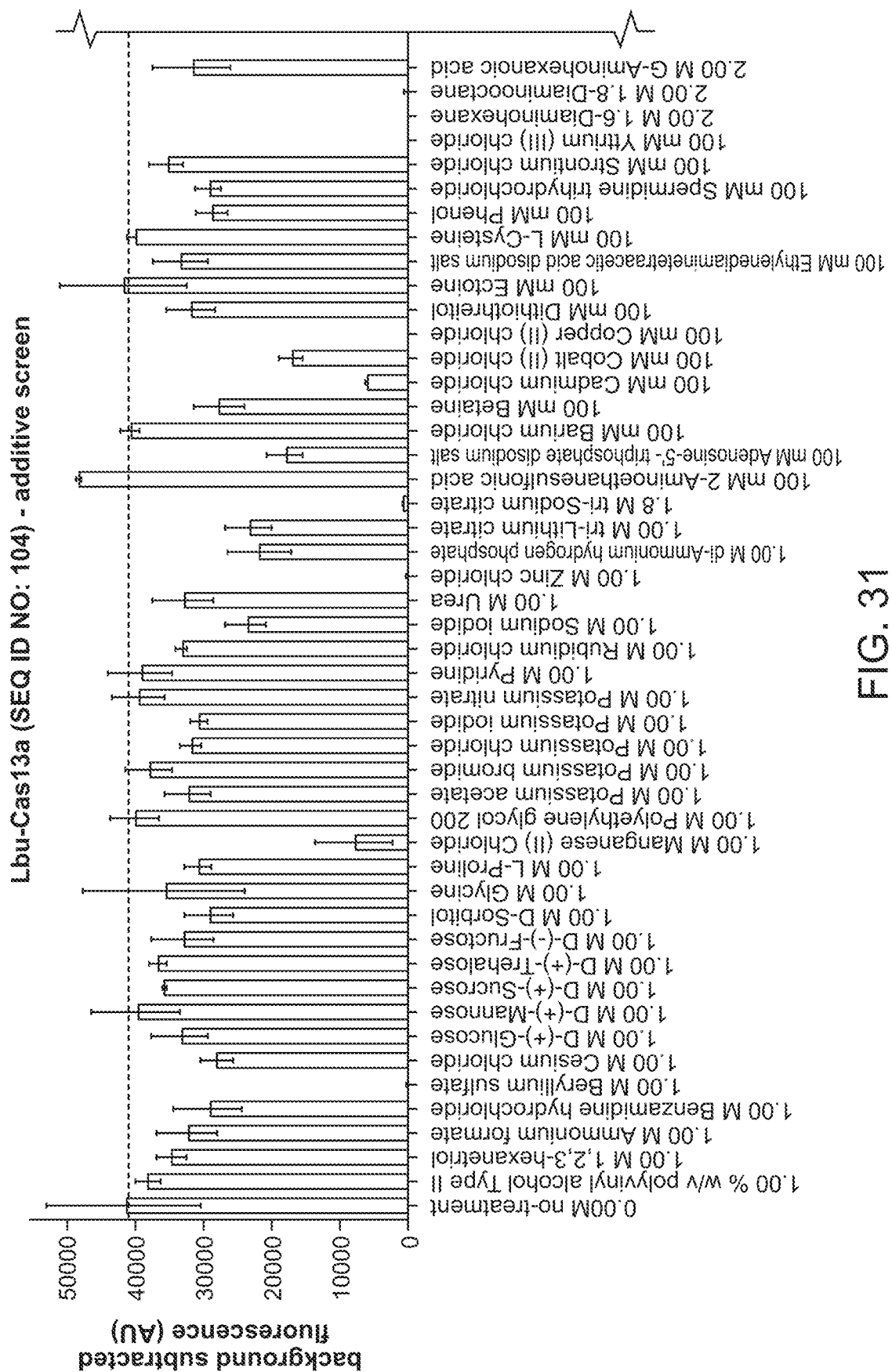
Figure 31:
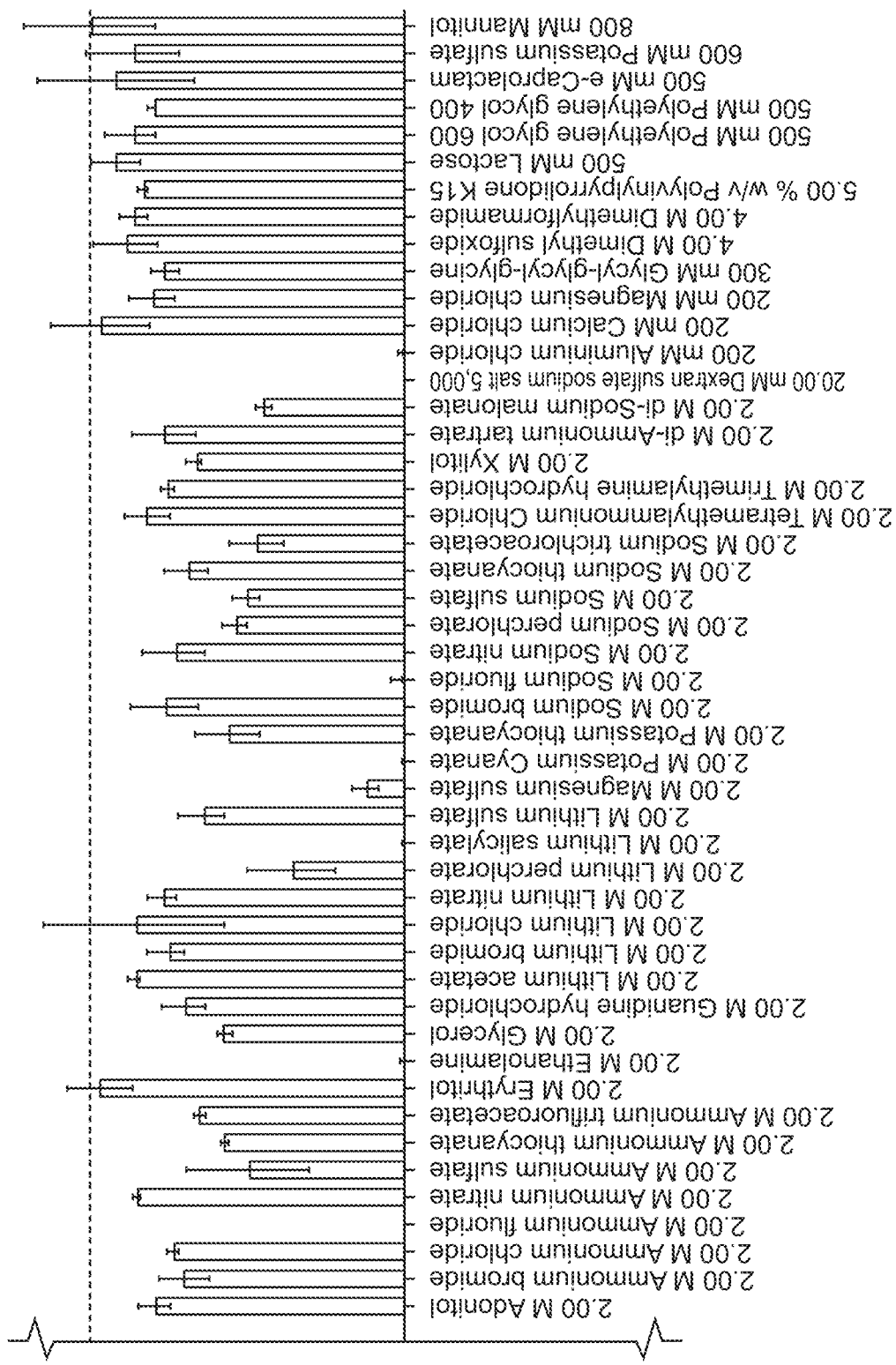

FIG. 31 shows Cas13a (SEQ ID NO: 104) performance in DETECTR assays, as measured by fluorescence, versus the different additives tested.

Figure 32:
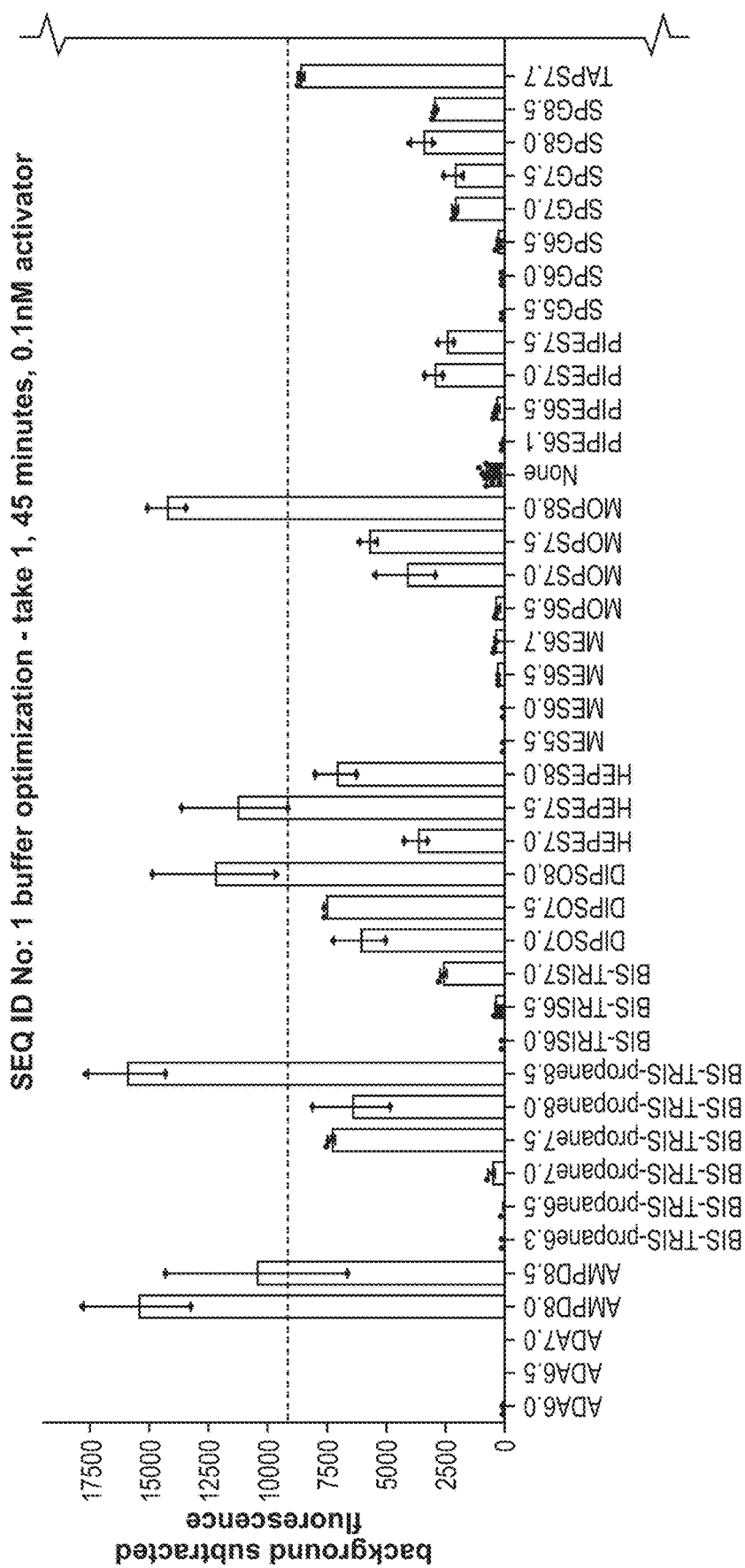
Figure 32:
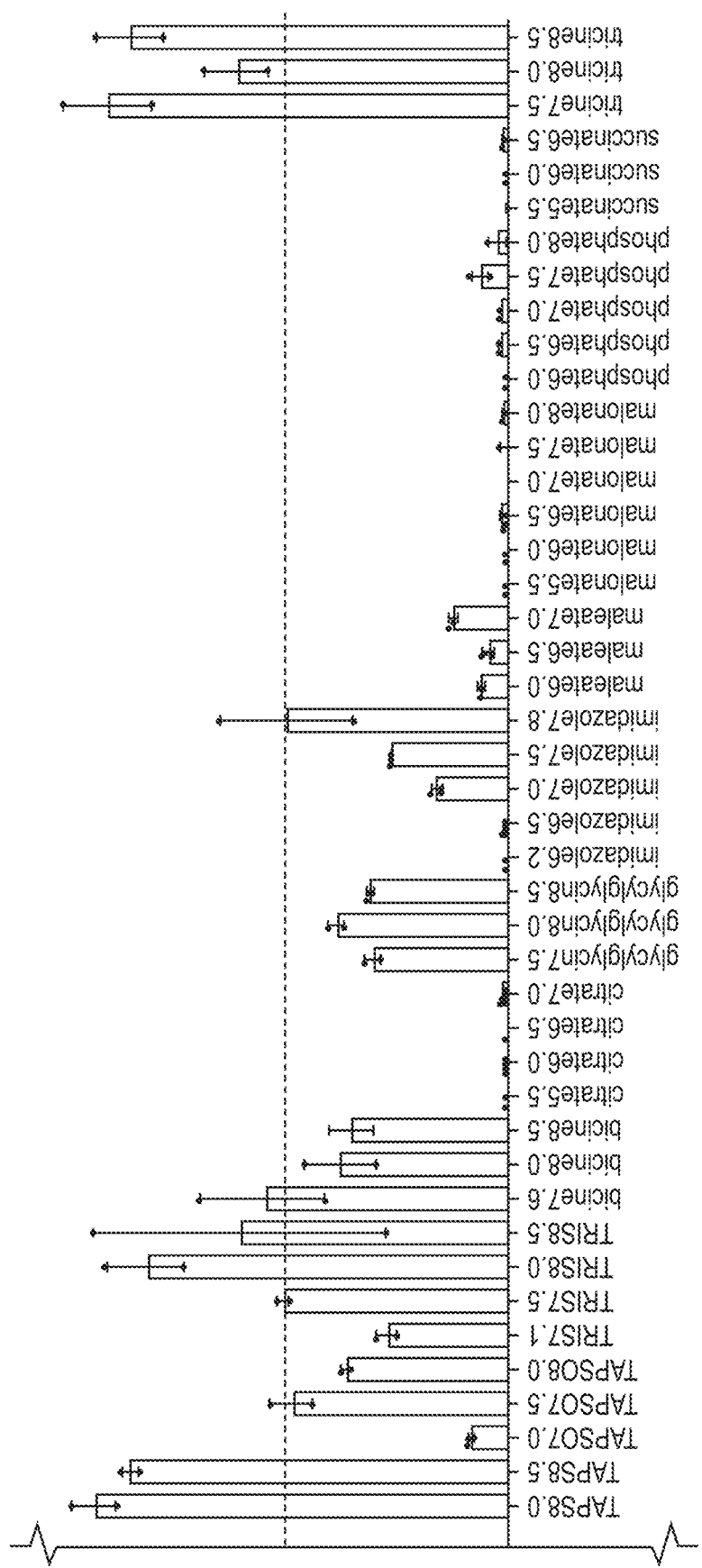

FIG. 32 shows the results of screening 84 different buffer and pH combinations to determine the optimal buffer for LbCas12a (SEQ ID NO: 1) activity in DETECTR assays, as measured by fluorescence.

Figure 33:
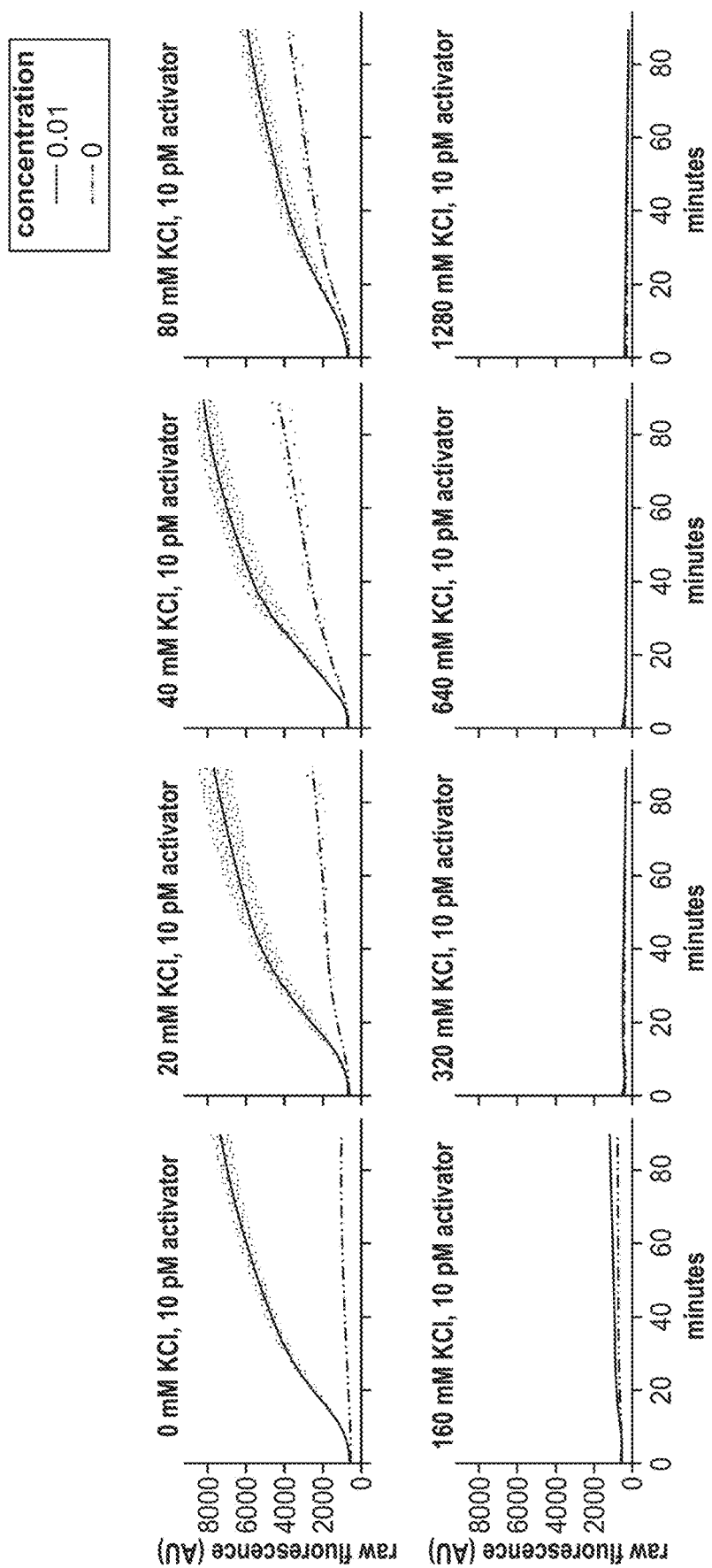

FIG. 33 shows LbCas12a (SEQ ID NO: 1) performance in DETECTR assays, as measured by fluorescence, in each of the tested conditions.

Figure 34:
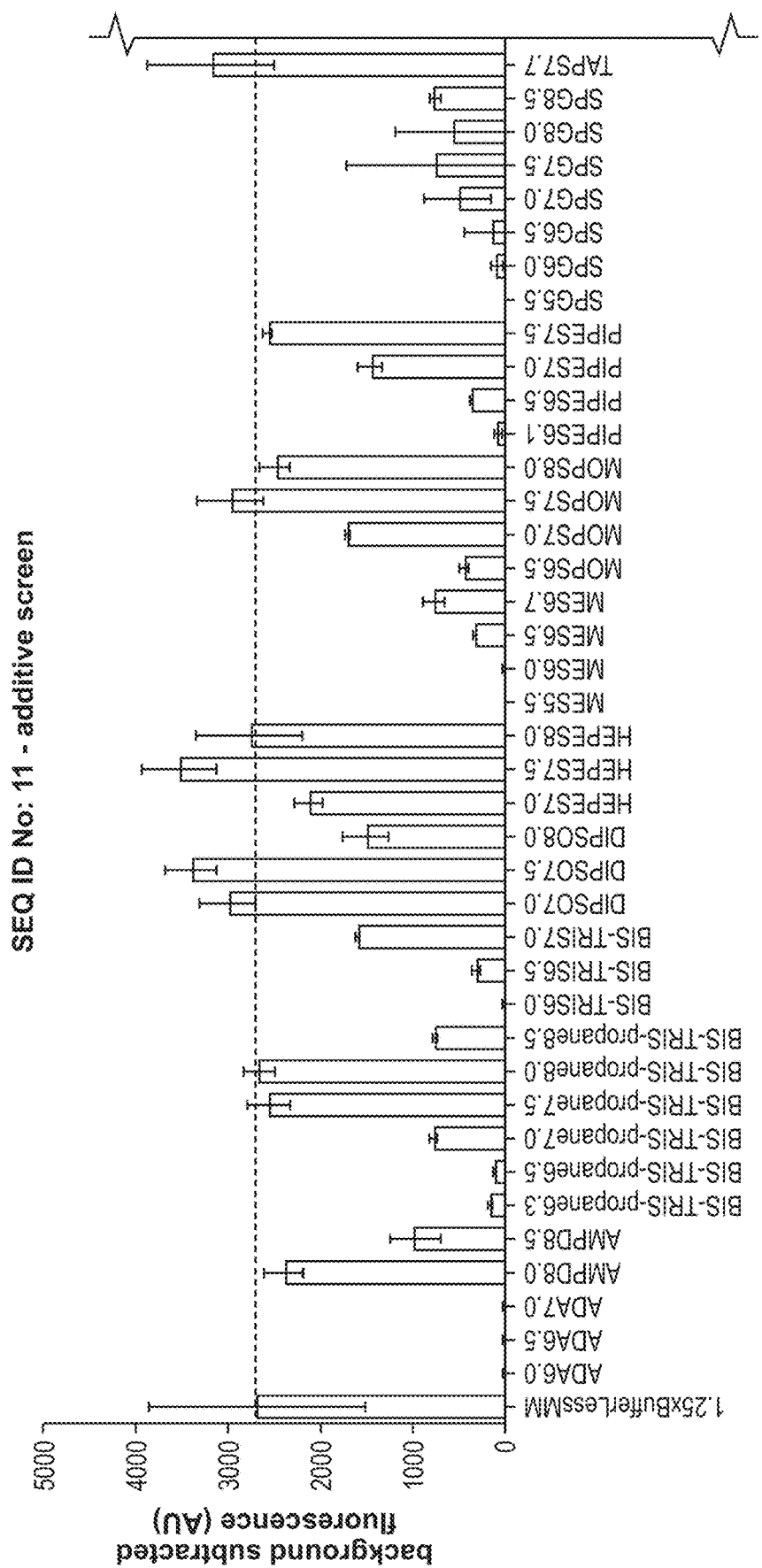
Figure 34:
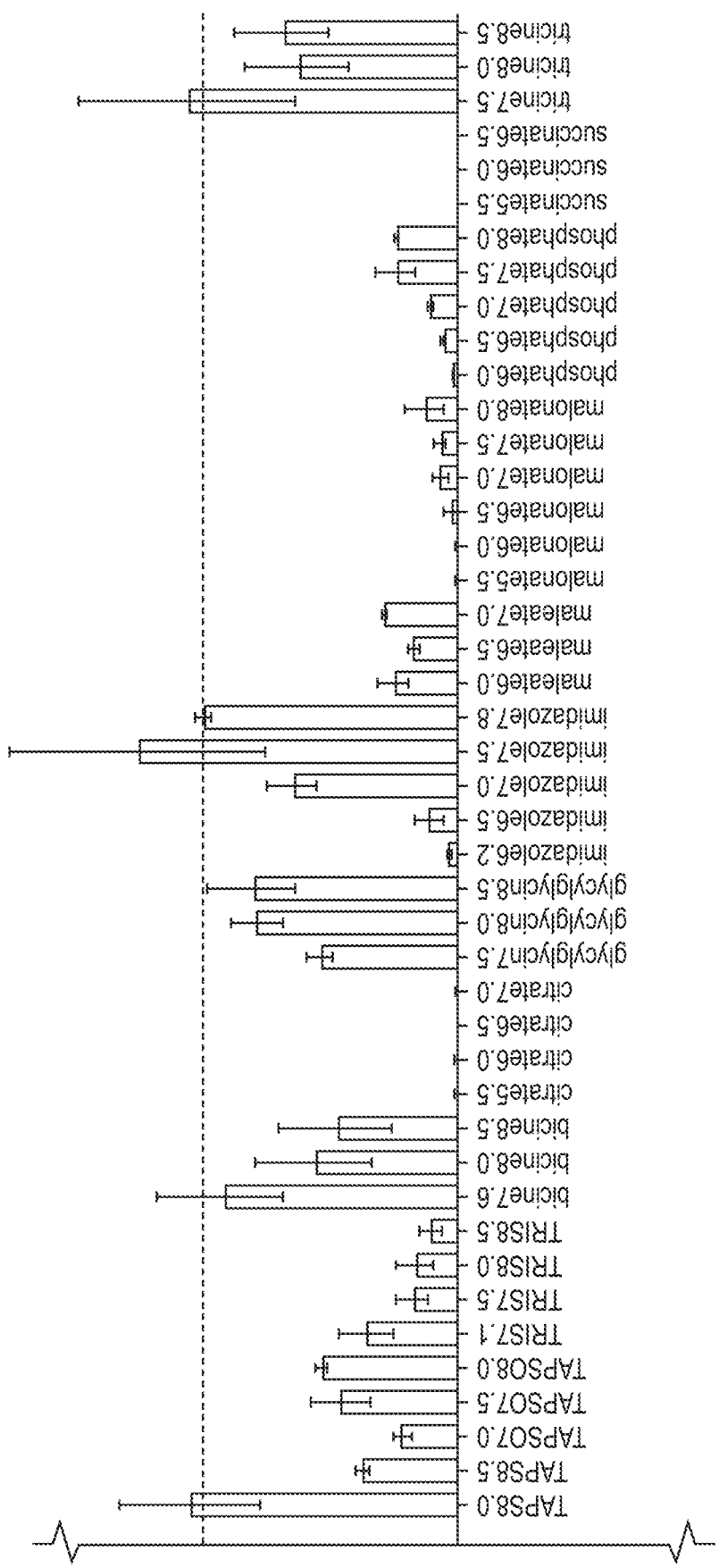

FIG. 34 shows a Cas12 variant (SEQ ID NO: 11) performance in DETECTR assays, as measured by fluorescence, for each of the tested conditions (buffer type and pH).

Figure 35:
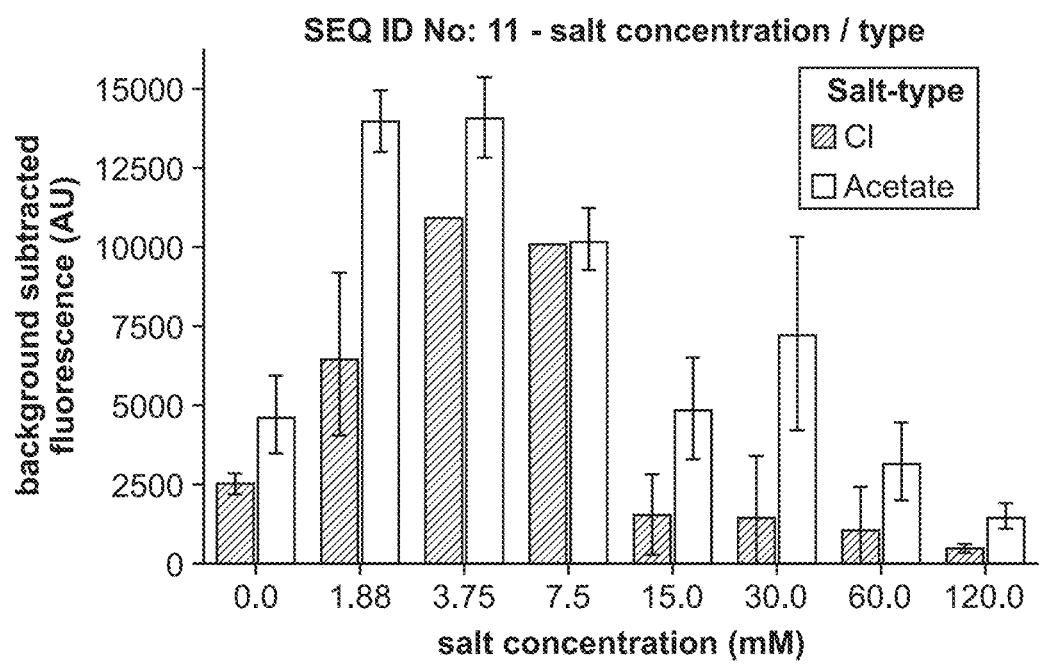

FIG. 35 shows a Cas12 variant (SEQ ID NO: 11) performance in DETECTR assays, as measured by fluorescence, for the various salt types and concentrations tested.

Figure 36:
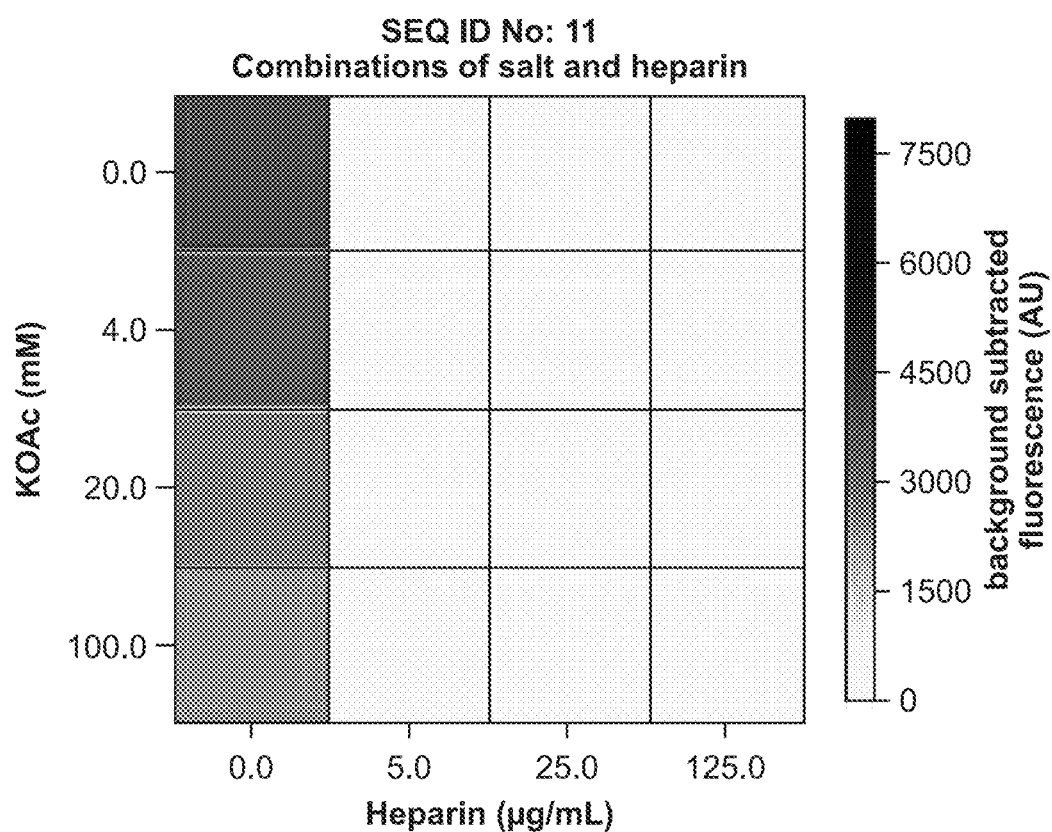

FIG. 36 shows a Cas12 variant (SEQ ID NO: 11) performance in DETECTR assays, as measured by fluorescence (darker squares indicate greater fluorescence and more activity), versus heparin concentration on the x-axis and KOAc buffer concentration on the y-axis.

Figure 37:
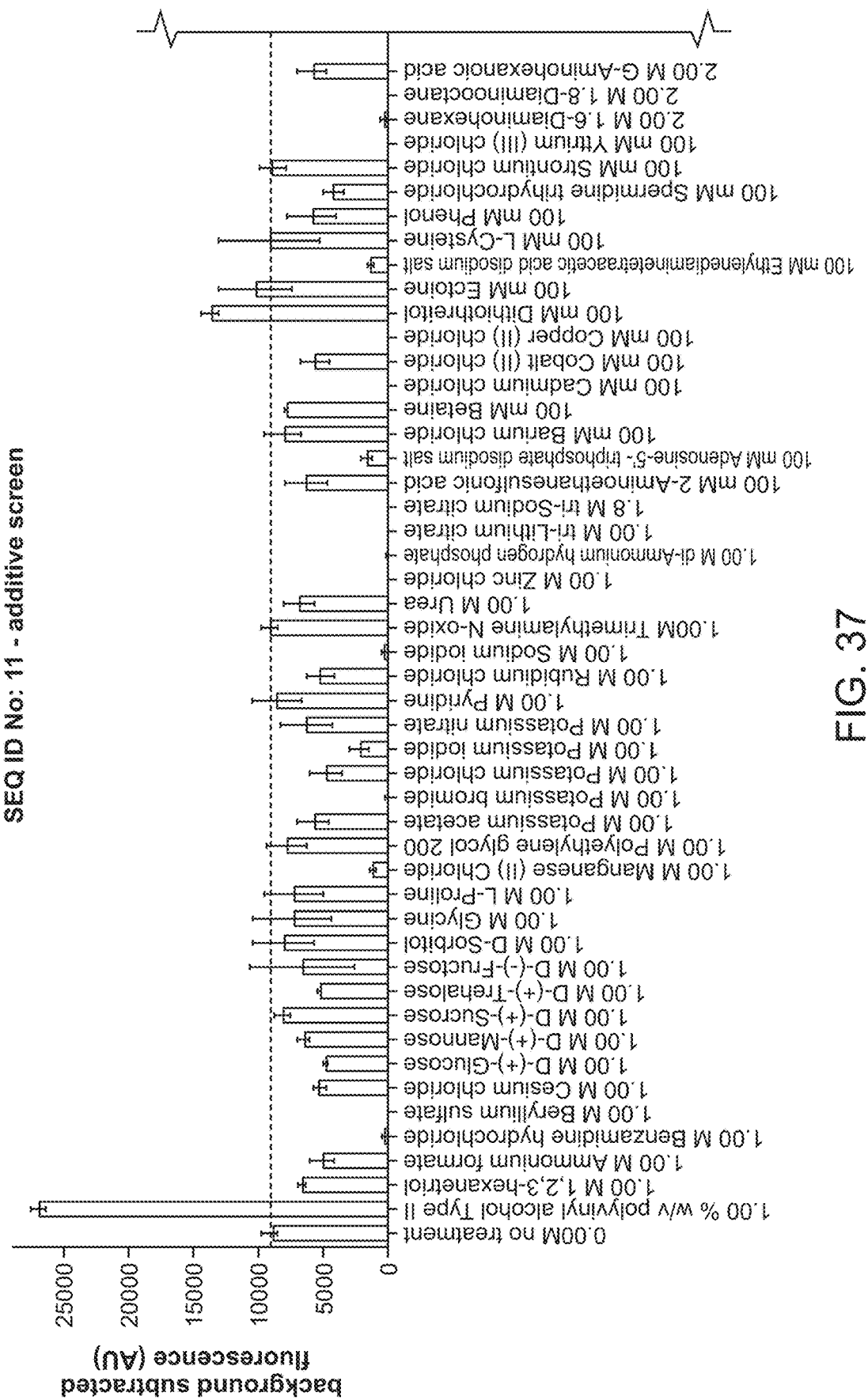
Figure 37:
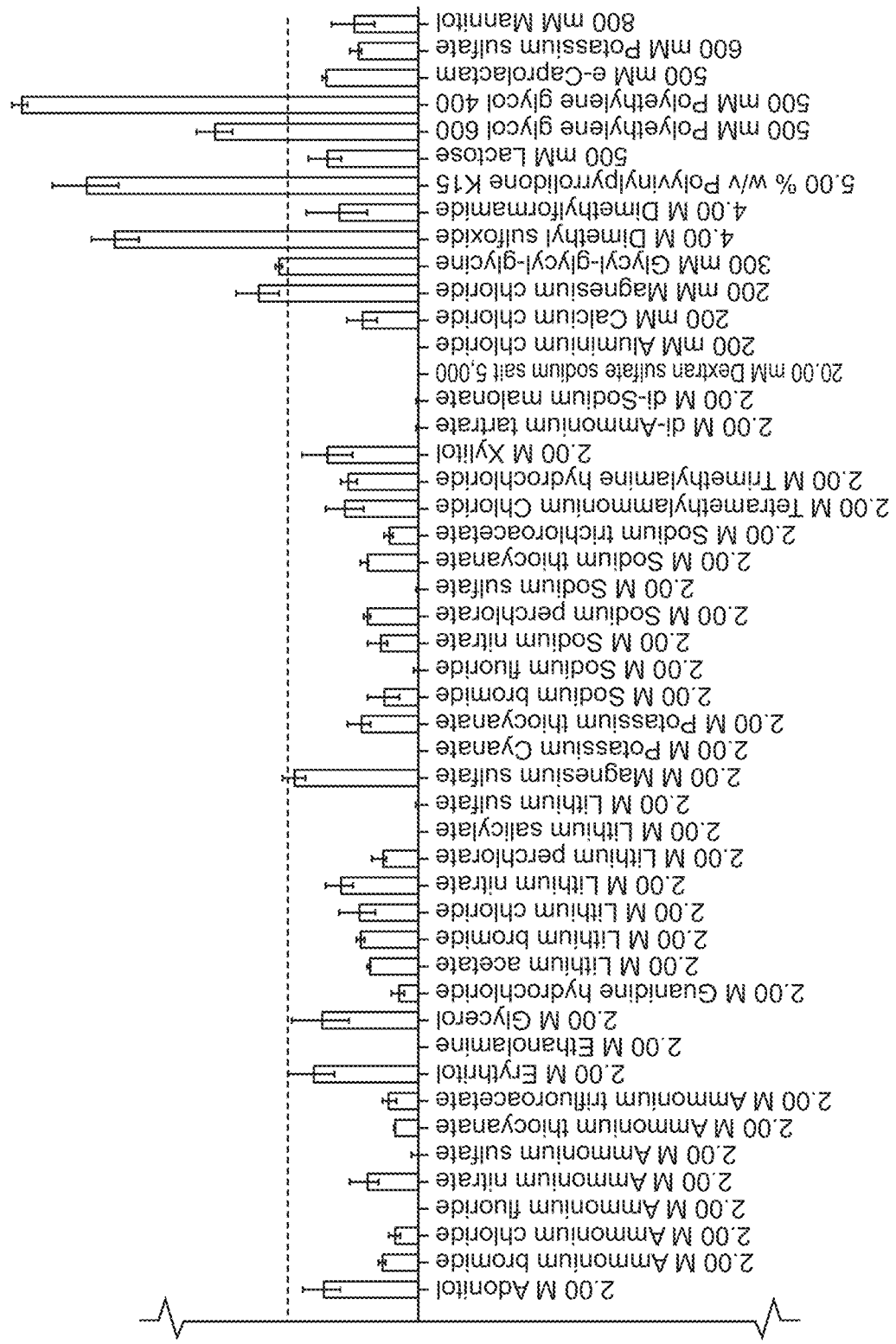

FIG. 37 shows that specific compounds inhibited the performance of the Cas12 variant (SEQ ID NO: 11) DETECTR assay including: benzamidine hydrochloride, beryllium sulfate, manganese chloride, potassium bromide, sodium iodine, zinc chloride, di-ammonium hydrogen phosphate, tri-lithium citrate, tri-sodium citrate, cadmium chloride, copper chloride, yttrium chloride, 1-6 diaminohexane, 1-8-diaminooctane, ammonium fluoride, and ammonium sulfate.

Figure 38:
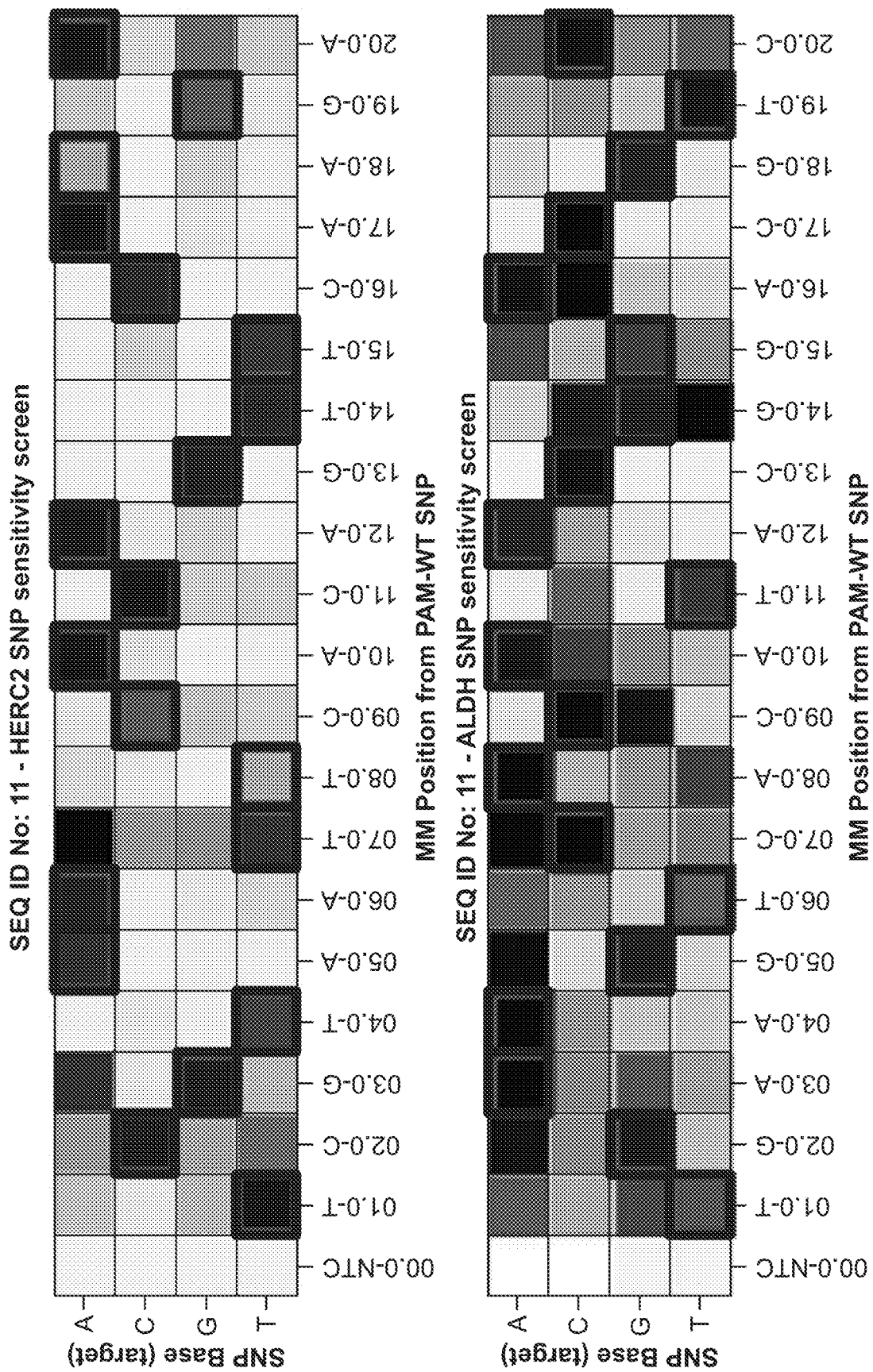

FIG. 38 shows the results of evaluating SNP sensitivity along target sequences for a Cas12 variant (SEQ ID NO: 11). Figure discloses SEQ ID NOS 416 and 417, respectively, in order of appearance.

Figure 39:
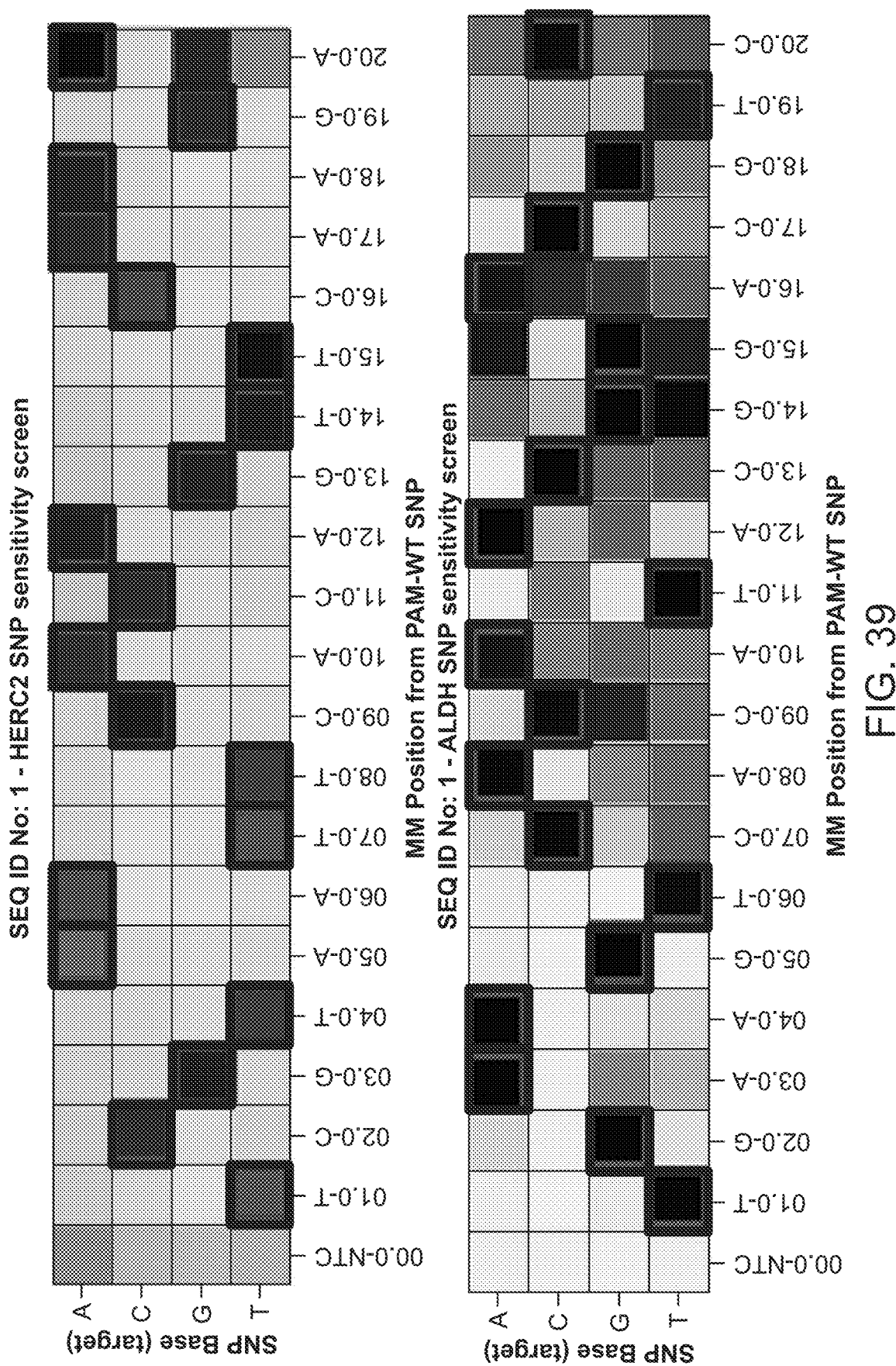

FIG. 39 shows the results of evaluating SNP sensitivity along target sequences for a Cas12 variant (SEQ ID NO: 11). Figure discloses SEQ ID NOS 416 and 417, respectively, in order of appearance.

Figure 40:
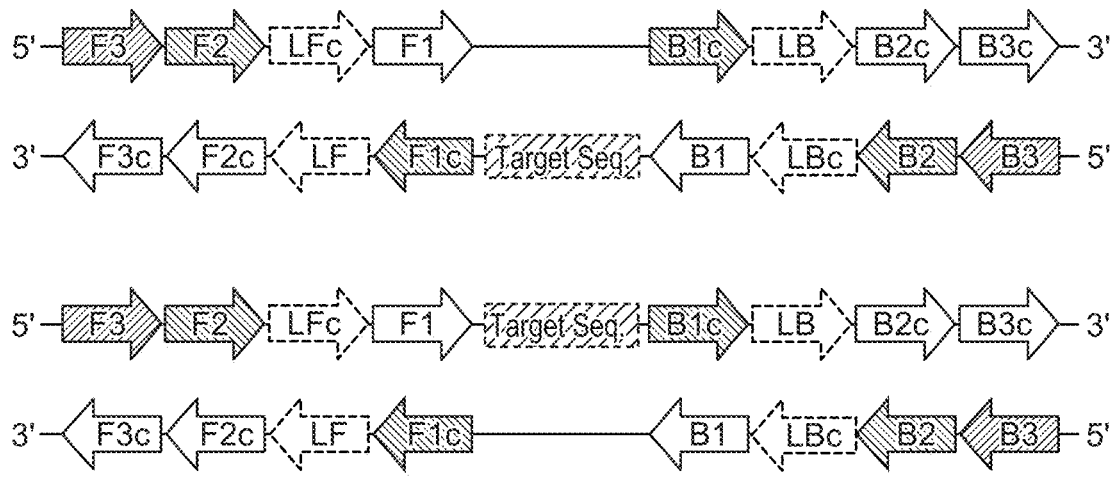
Figure 40:
Figure 40:
Figure 40:
Figure 40:
Figure 40:
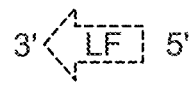
Figure 40:

FIG. 40 shows schemes for designing primers for loop mediated isothermal amplification (LAMP) of a target nucleic acid sequence. Regions denoted by "c" are reverse complementary to the corresponding region not denoted by "c" (e.g., region F3c is reverse complementary to region F3).

FIG. 41A, FIG. 41B, FIG. 41C, and FIG. 41D show schematics of exemplary configurations of various regions of a nucleic acid sequence that correspond to or anneal LAMP primers or guide RNA sequences, or that comprise protospacer-adjacent motif (PAM) or protospacer flanking site (PFS), and target nucleic acid sequences for amplification and detection by LAMP and DETECTR.

Figure 41A:
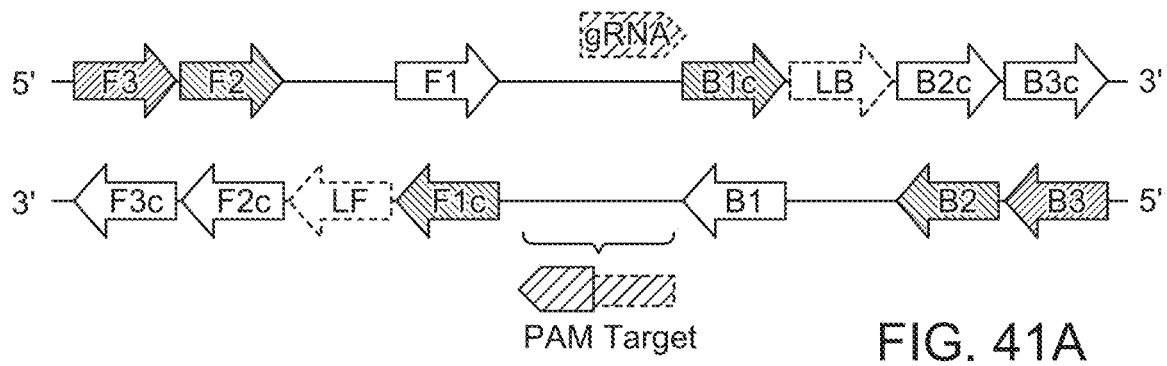

FIG. 41A shows a schematic of an exemplary arrangement of the guide RNA (gRNA) with respect to the various regions of the nucleic acid sequence that correspond to or anneal LAMP primers. In this arrangement, the guide RNA is reverse complementary to a sequence of the target nucleic acid, which is between an F1c region (a region reverse complementary to an F1 region) and a B1 region.

Figure 41B:
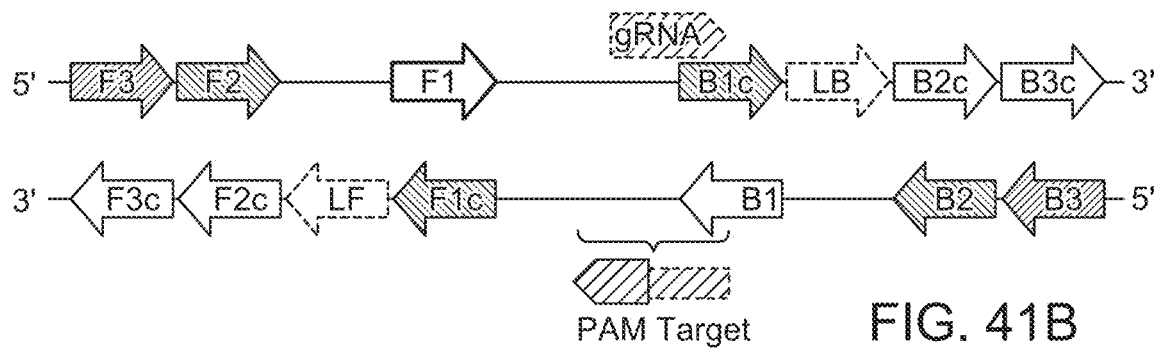

FIG. 41B shows a schematic of an exemplary arrangement of the guide RNA sequence with respect to the various regions of the nucleic acid sequence that correspond to or anneal LAMP primers. In this arrangement, the guide RNA is partially reverse complementary to a sequence of the target nucleic acid, which is between an F1c region and a B1 region. For example, the target nucleic acid comprises a sequence between an F1c region and a B1 region that is reverse complementary to at least 60% of a guide nucleic acid. In this arrangement, the guide RNA is not reverse complementary to the forward inner primer or the backward inner primer shown in FIG. 40.

Figure 41C:
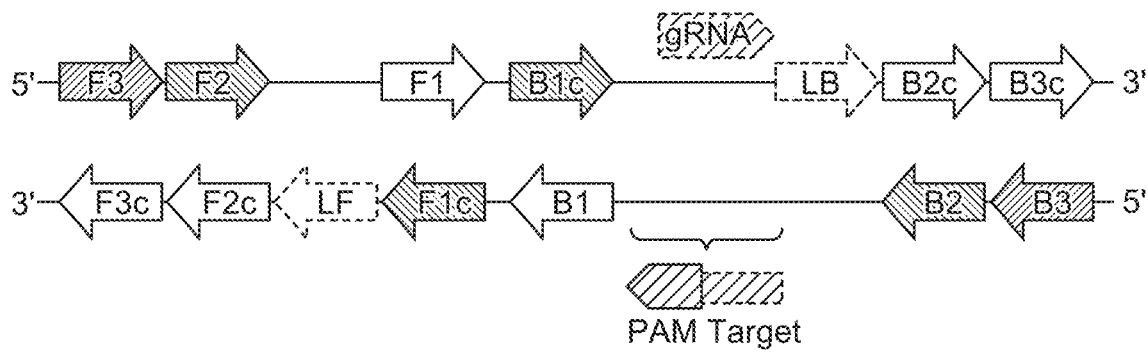

FIG. 41C shows a schematic of an exemplary arrangement of the guide RNA with respect to the various regions of the nucleic acid sequence that correspond to or anneal LAMP primers. In this arrangement, the guide RNA hybridizes to a sequence of the target nucleic acid, which is within the loop region between the B1 region and the B2 region. The primer sequences do not contain and are not reverse complementary to the PAM or PFS.

Figure 41D:
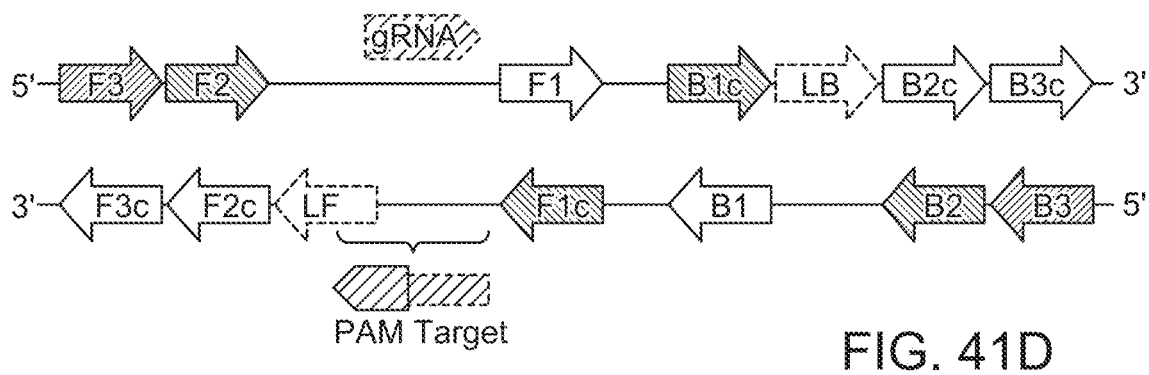

FIG. 41D shows a schematic of an exemplary arrangement of the guide RNA with respect to the various regions of the nucleic acid sequence that correspond to or anneal LAMP primers. In this arrangement, the guide RNA hybridizes to a sequence of the target nucleic acid, which is within the loop region between the F2c region and F1c region. The forward inner primer, backward inner primer, forward outer primer, and backward outer primer sequences do not contain and are not reverse complementary to the PAM or PFS.

Figure 42A:
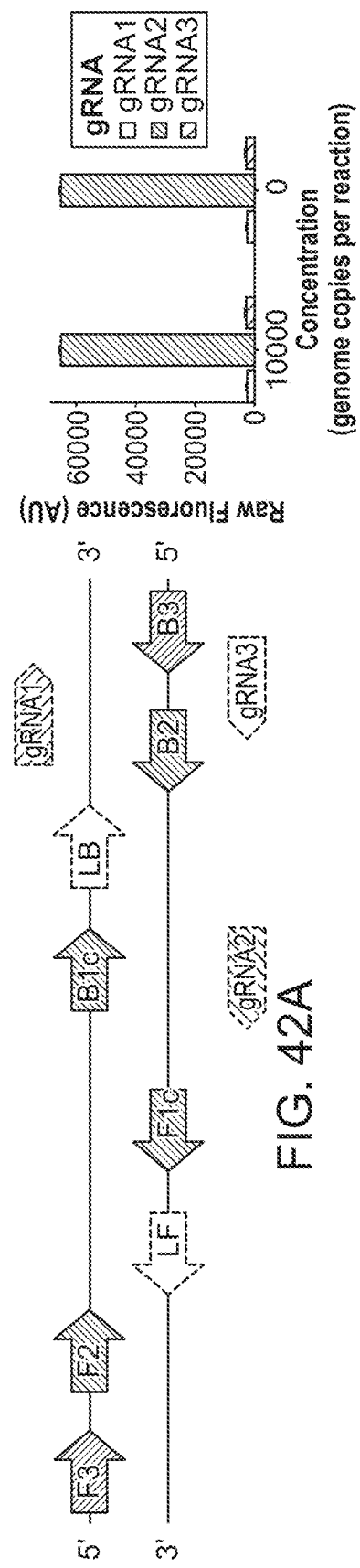
Figure 42B:
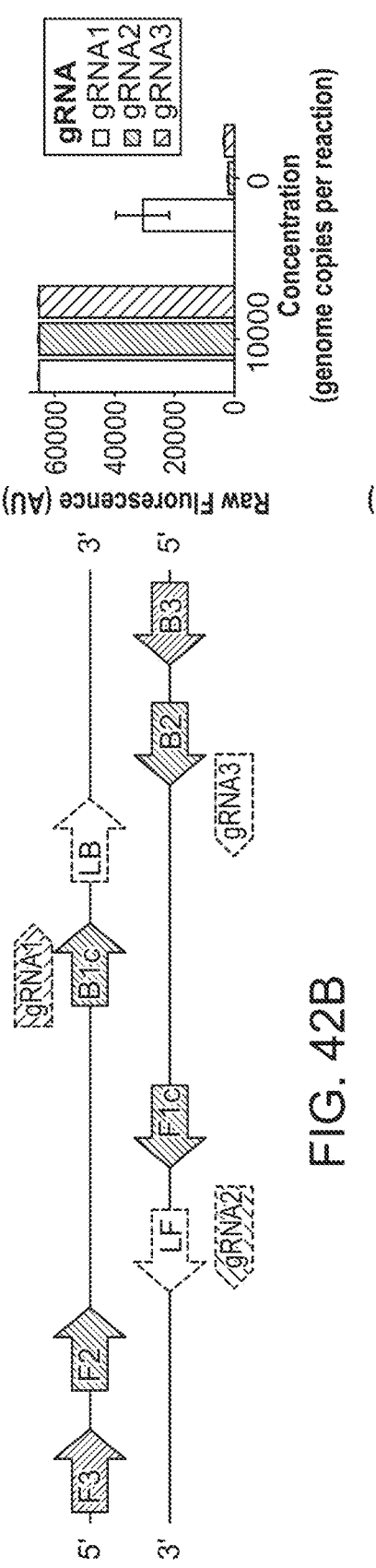
Figure 42C:
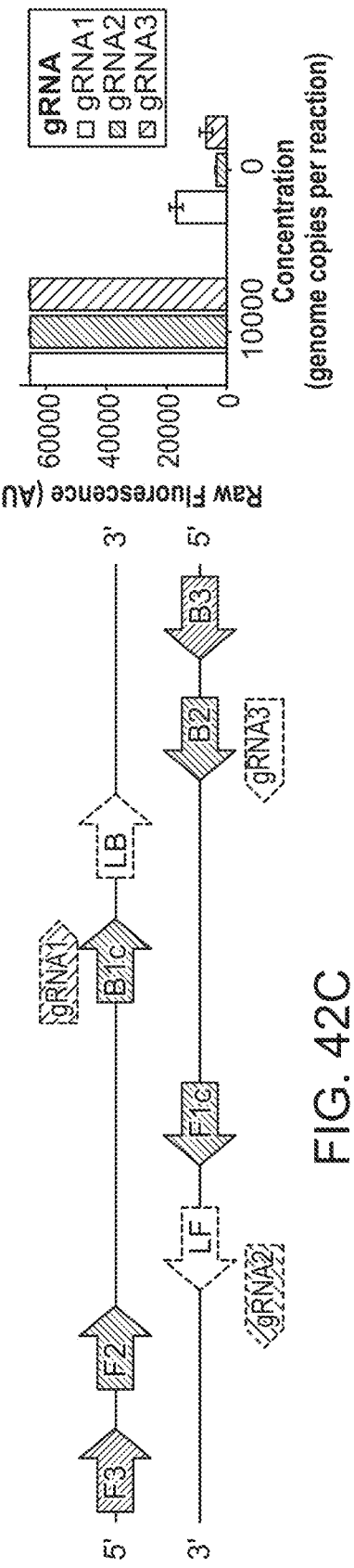

FIG. 42A, FIG. 42B, and FIG. 42C show schematics of exemplary configurations of various regions of the nucleic acid sequence that correspond to or anneal LAMP primers or guide RNA sequences, or comprise protospacer-adjacent motif (PAM) or protospacer flanking site (PFS), and target nucleic acid sequences for combined LAMP and DETECTR for amplification and detection, respectively. At the right, the schematics also show corresponding fluorescence data using the LAMP amplification and guide RNA sequences to detect the presence of a target nucleic acid sequence, where a fluorescence signal is the output of the DETECTR reaction and indicates presence of the target nucleic acid.

FIG. 42A shows a schematic of an arrangement of various regions of the nucleic acid sequence that correspond to or anneal LAMP primers (SEQ ID NO: 201, SEQ ID NO: 202, SEQ ID NO: 205, SEQ ID NO: 206, and SEQ ID NO: 249-SEQ ID NO: 252) and positions of three guide RNAs (gRNA1 (SEQ ID NO: 261), gRNA2 (SEQ ID NO: 262), and gRNA3 (SEQ ID NO: 263)) relative to the LAMP primers (at left). gRNA1 overlaps with the B2c region and is, thus, reverse complementary to the B2 region. gRNA2 overlaps with the B1 region and is, thus, reverse complementary to the B1c region. gRNA3 partially overlaps with the B3 region and partially overlaps with the B2 region and is, thus, partially reverse complementary to the B3c region and partially reverse complementary to the B2c region. The complementary regions (B1c, B2c, B3c, F1c, F2c, and F3c) are not depicted, but correspond to the regions shown in FIG. 40. At right is a graph of fluorescence from the DETECTR reaction in the presence of 10,000 genome copies (before amplification) of the target nucleic acid or 0 genome copies of the target nucleic acid.

FIG. 42B shows a schematic of an arrangement of various regions of the nucleic acid sequence that correspond to or anneal LAMP primers (SEQ ID NO: 202, SEQ ID NO: 210, SEQ ID NO: 211, SEQ ID NO: 214, SEQ ID NO: 215, SEQ ID NO: 253-SEQ ID NO: 255) and positions of three guide RNAs (gRNA1 (SEQ ID NO: 261), gRNA2 (SEQ ID NO: 262), and gRNA3 (SEQ ID NO: 263)) relative to the LAMP primers (at left). gRNA1 overlaps with the B1c region and is, thus, reverse complementary to the B1 region. gRNA2 overlaps with the LF region and is, thus, reverse complementary to the LFc region. gRNA 3 partially overlaps with the B2 region and partially overlaps with the LBc region and is, thus, partially reverse complementary to the B2c region and is partially reverse complementary to the LB region. At right is a graph of fluorescence from the DETECTR reaction in the presence of 10,000 genome copies (before amplification) of the target nucleic acid or 0 genome copies of the target nucleic acid.

FIG. 42C shows a schematic of an arrangement of various regions of the nucleic acid sequence that correspond to or anneal LAMP primers (SEQ ID NO: 184, SEQ ID NO: 188, SEQ ID NO: 255-SEQ ID NO: 260) and positions of three guide RNAs (gRNA1 (SEQ ID NO: 261), gRNA2 (SEQ ID NO: 262), and gRNA3 (SEQ ID NO: 263)) relative to the LAMP primers (at left). gRNA1 overlaps with the B1c region and is, thus, reverse complementary to the B1 region. gRNA2 partially overlaps with the LF region and partially overlaps with the F2c region and is, thus, partially reverse complementary to the LFc region and partially reverse complementary to the F2 region. gRNA3 overlaps with the B2 and is, thus, reverse complementary to the B2c region. At right is a graph of fluorescence from the DETECTR reaction in the presence of 10,000 genome copies (before amplification) of the target nucleic acid or 0 genome copies of the target nucleic acid.

Figure 43A:
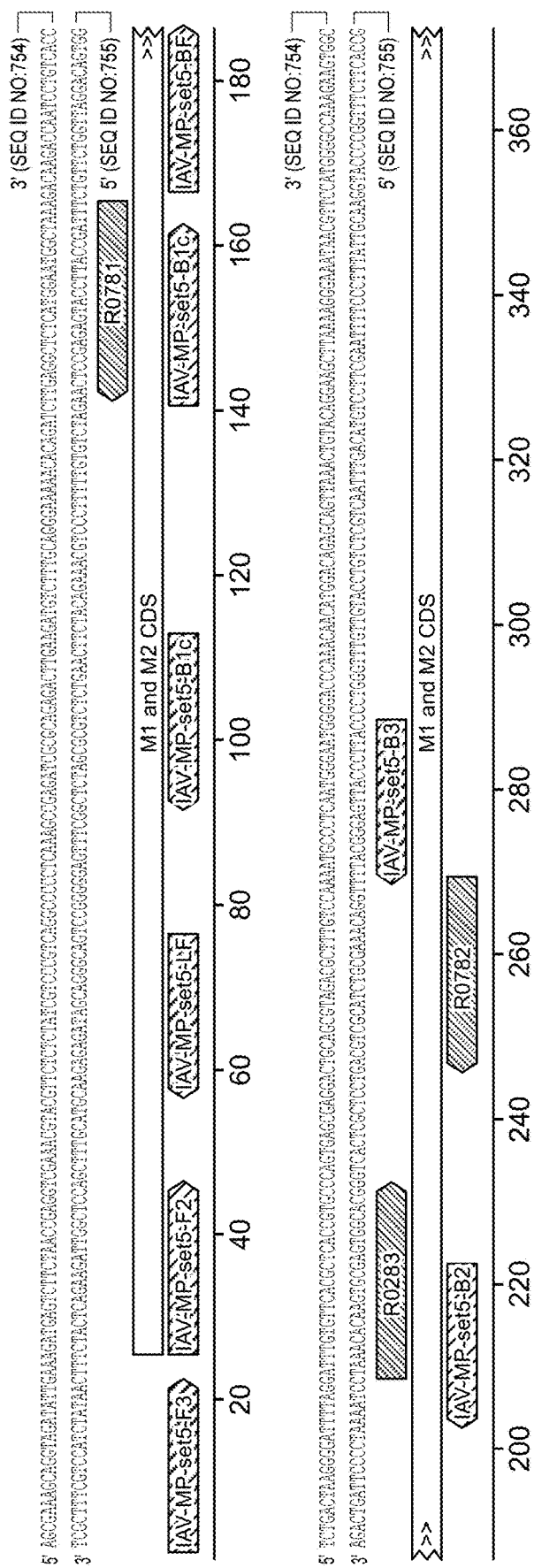

FIG. 43A shows a detailed breakdown of the arrangement and sequences of various regions of the nucleic acid sequence that correspond to or anneal LAMP primers or guide RNA sequences, or comprise protospacer-adjacent motif (PAM) or protospacer flanking site (PFS), and target nucleic acid sequences for the LAMP and DETECTR assays shown in FIG. 42A.

Figure 43B:
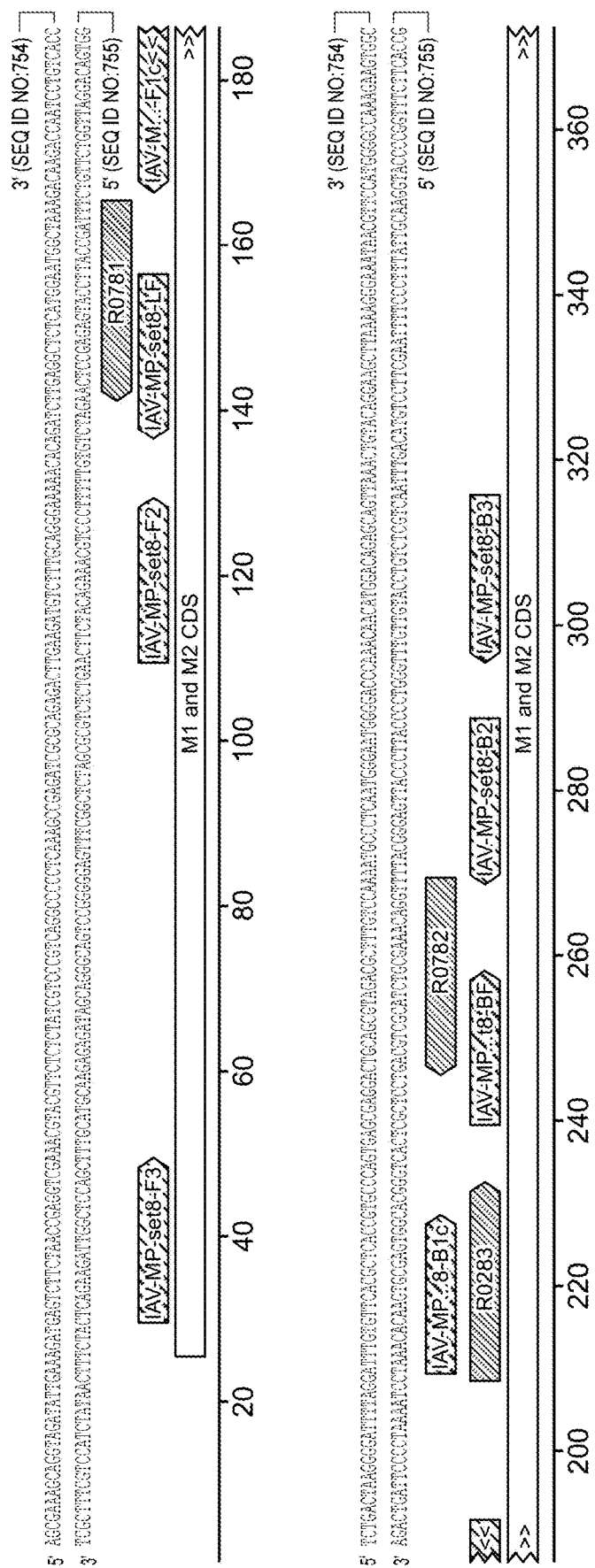

FIG. 43B shows a detailed breakdown of the arrangement and sequences of various regions of the nucleic acid sequence that correspond to or anneal LAMP primers or guide RNA sequences, or comprise protospacer-adjacent motif (PAM) or protospacer flanking site (PFS), and target nucleic acid sequences for the LAMP and DETECTR assays shown in FIG. 42B.

Figure 43C:
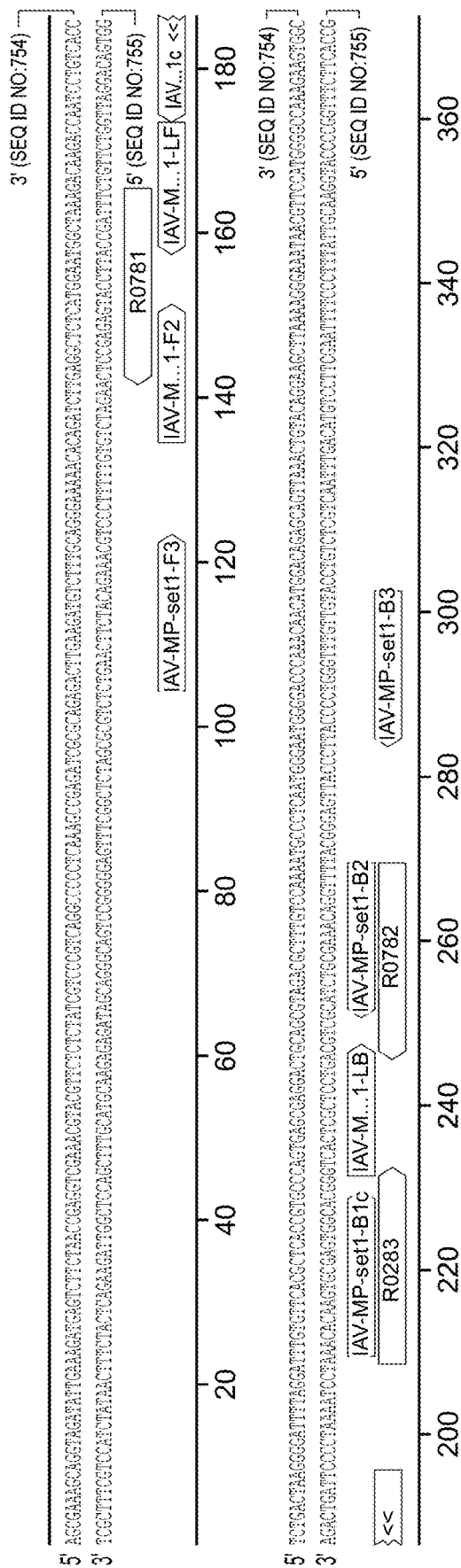

FIG. 43C shows a detailed breakdown of the arrangement and sequences of various regions of the nucleic acid sequence that correspond to or anneal LAMP primers or guide RNA sequences, or comprise protospacer-adjacent motif (PAM) or protospacer flanking site (PFS), and target nucleic acid sequences for the LAMP and DETECTR assays shown in FIG. 42C.

Figure 44:
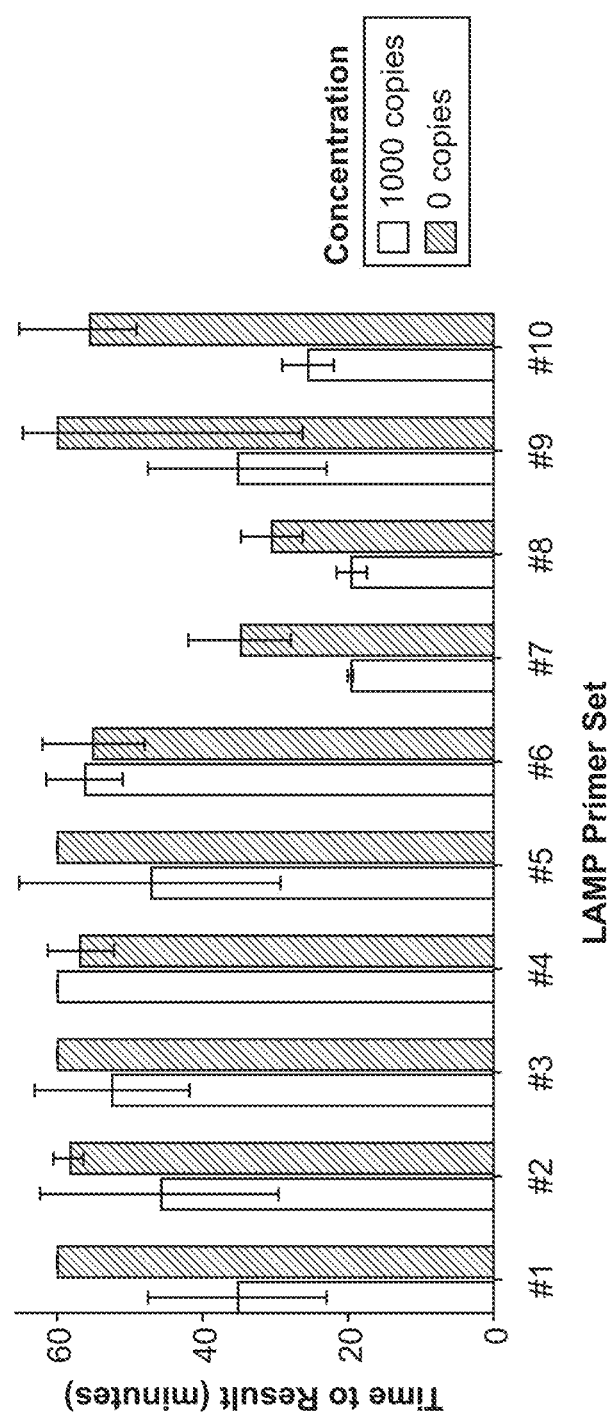

FIG. 44 shows the time to result of a reverse-transcription LAMP (RT-LAMP) reaction detected using a DNA binding dye. Amplification was performed using primer sets #1-#10. Sequences of the primer sets are provided in TABLE 10.

Figure 45:
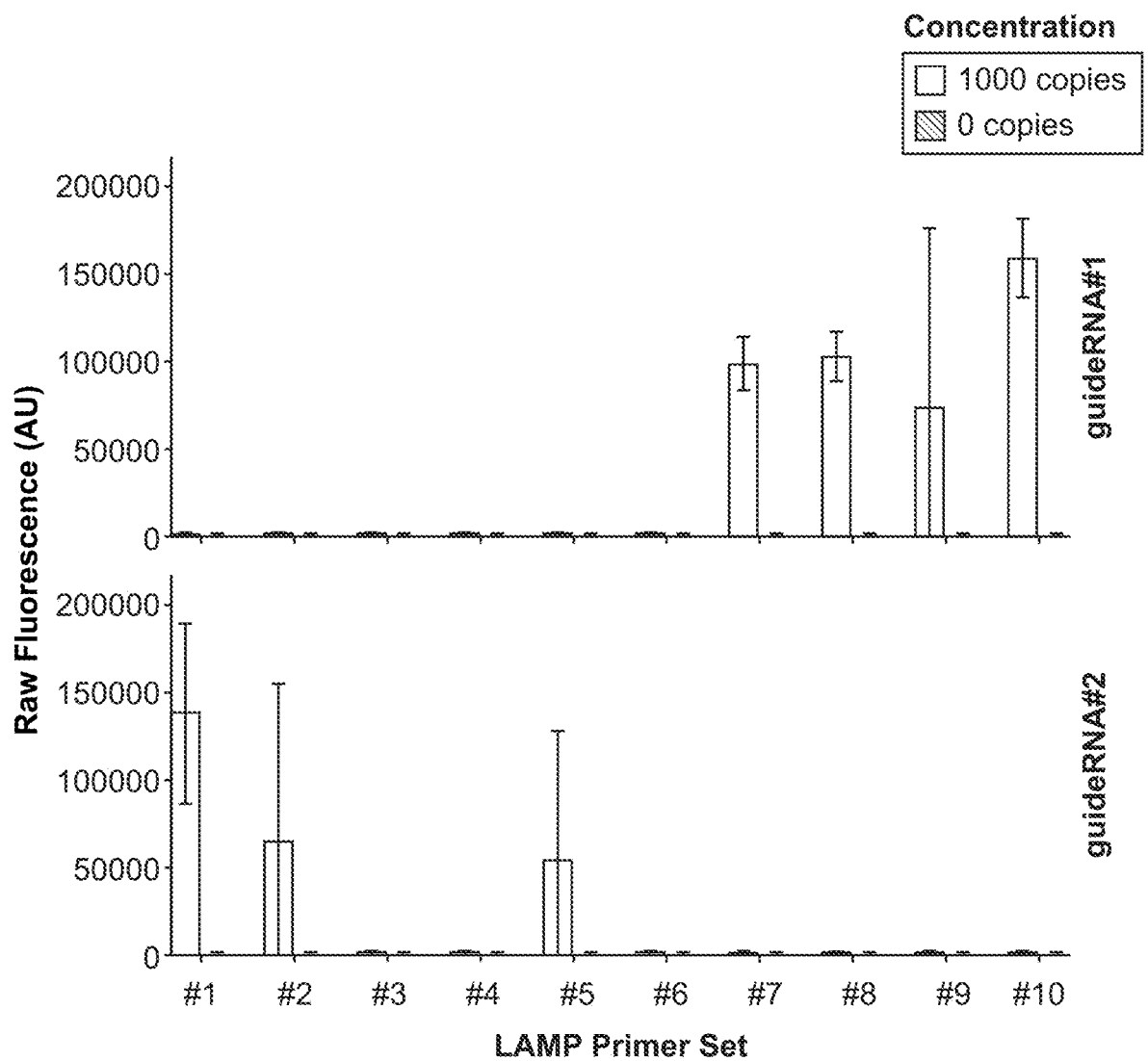

FIG. 45 shows fluorescence signal from a DETECTR reaction following a five-minute incubation with products from RT-LAMP reactions. Amplification was performed using primer sets #1-#10. Sequences of the primer sets are provided in TABLE 10. LAMP primer sets #1-6 were designed for use with guide RNA #2 (SEQ ID NO: 240), and LAMP primer sets #7-10 were designed for use with guide RNA #1 (SEQ ID NO: 239).

Figure 46:
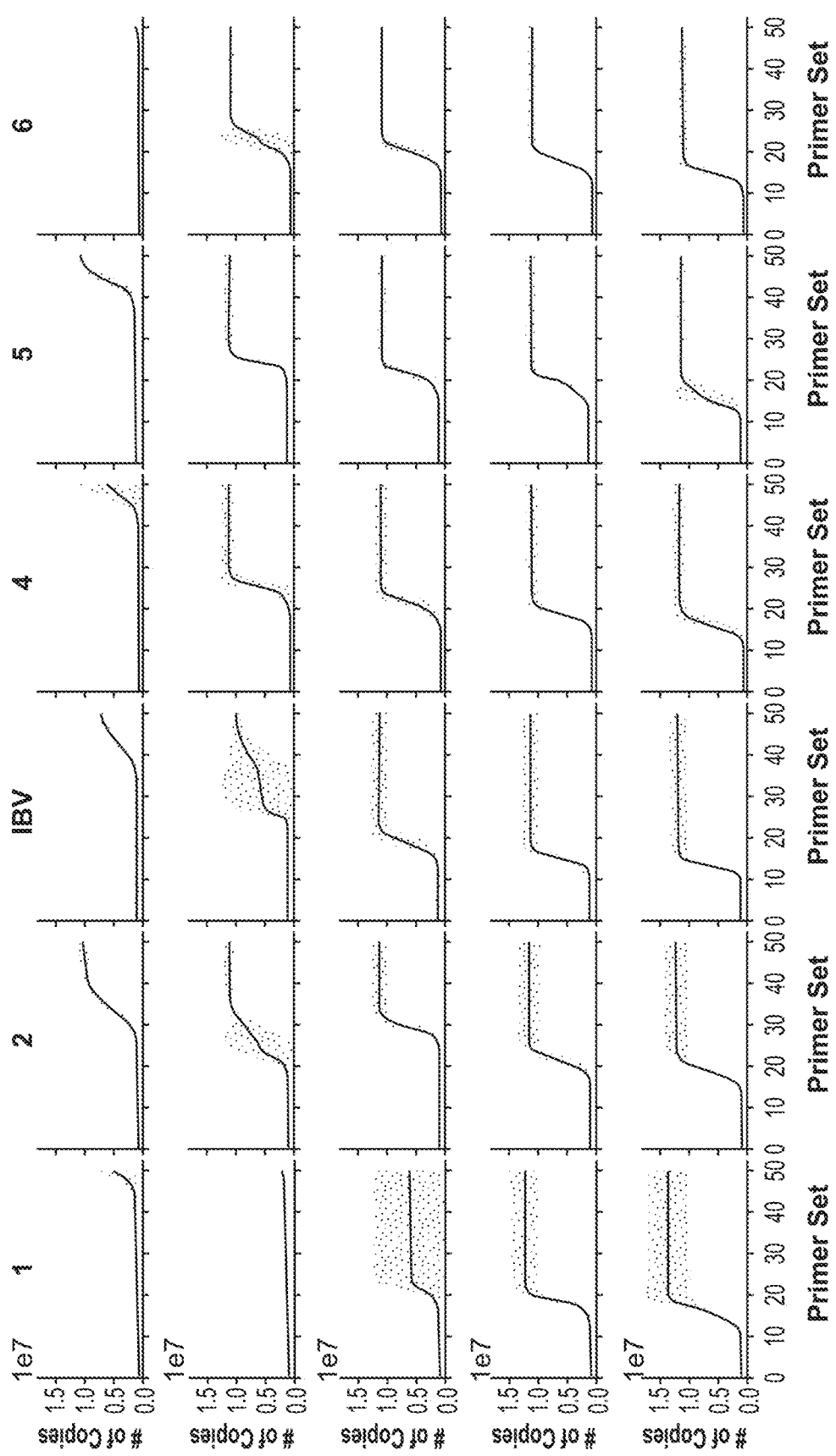
Figure 46:
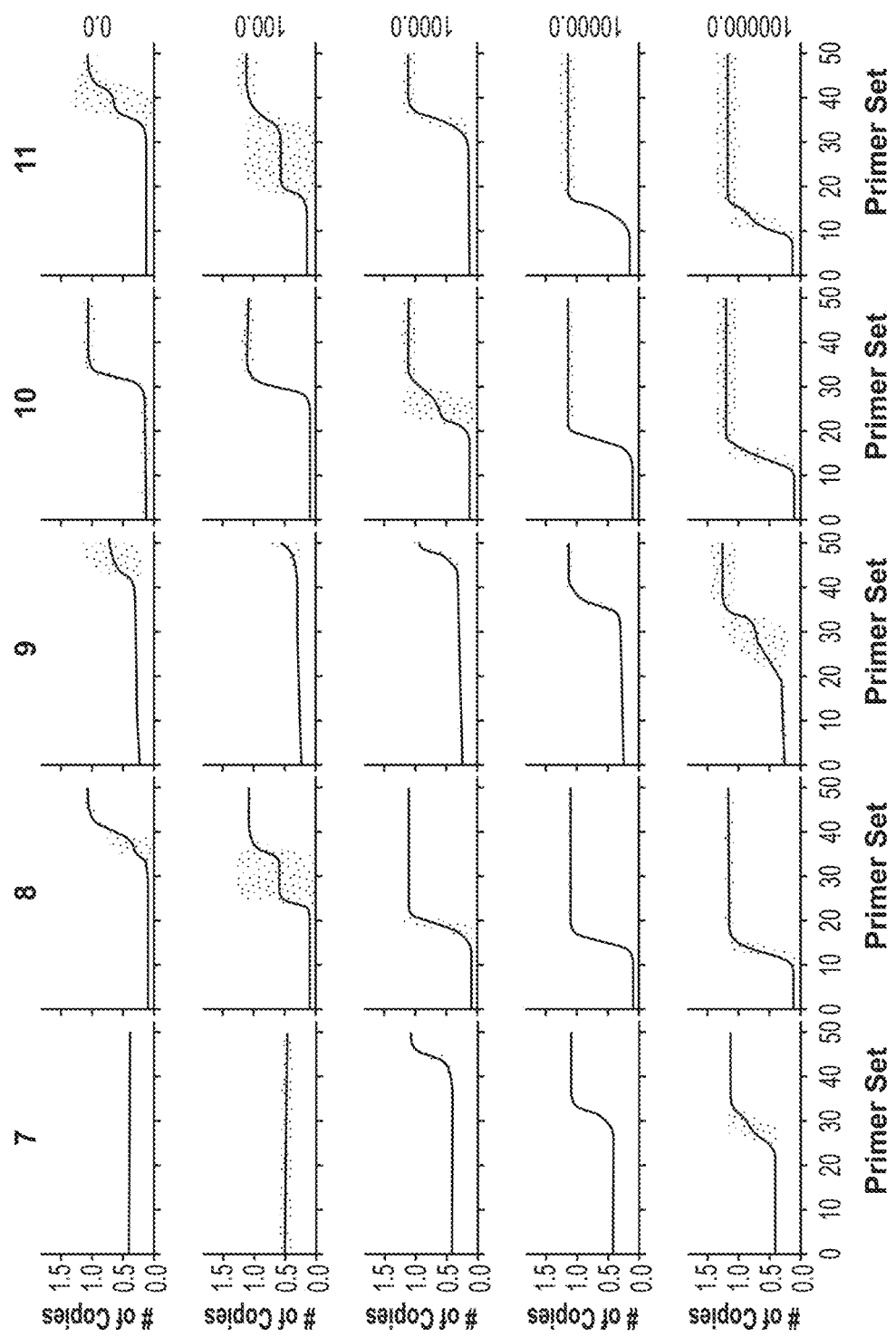

FIG. 46 shows detection of sequences from influenza A virus (IAV) using SYTO 9 (a DNA binding dye) following RT-LAMP amplification with LAMP primer sets 1, 2, 4, 5, 6, 7, 8, 9, 10, or a negative control. Sequences of the primer sets are provided in TABLE 12.

Figure 47:
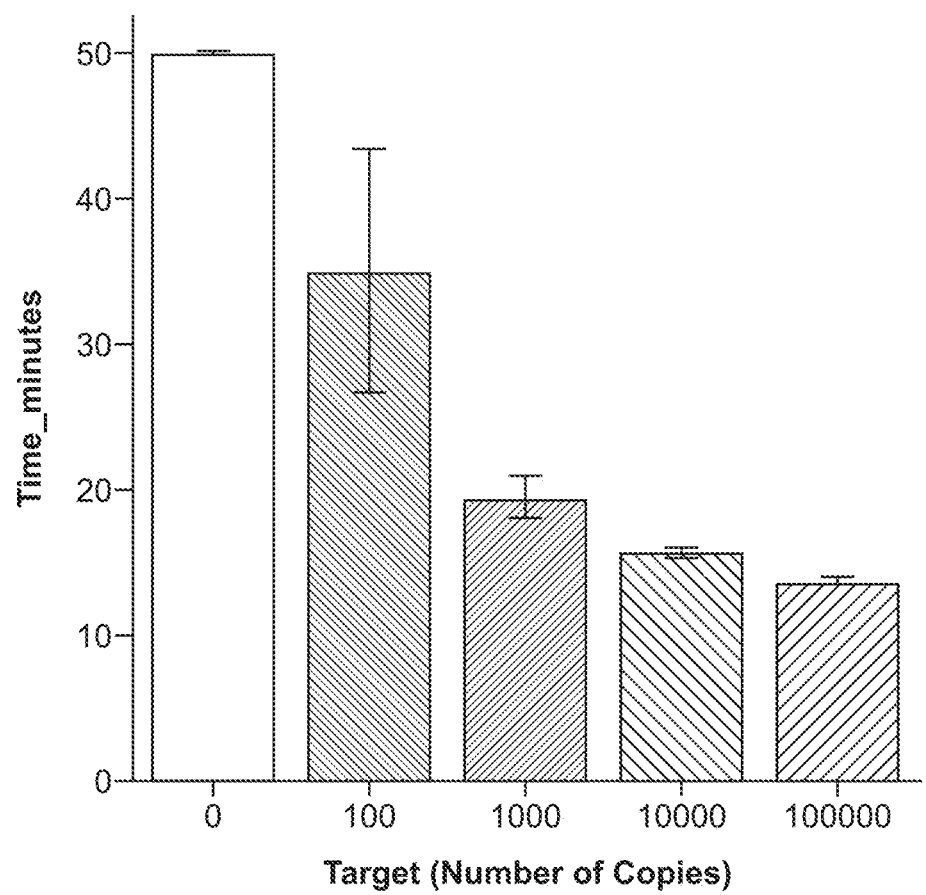

FIG. 47 shows the time to amplification of an influenza B virus (IBV) target sequence following RT-LAMP amplification. Amplification was detected using SYTO 9 in the presence of increasing concentrations of target sequence (0, 100, 1000, 10,000, or 100,000 genome copies of the target sequence per reaction).

Figure 48:
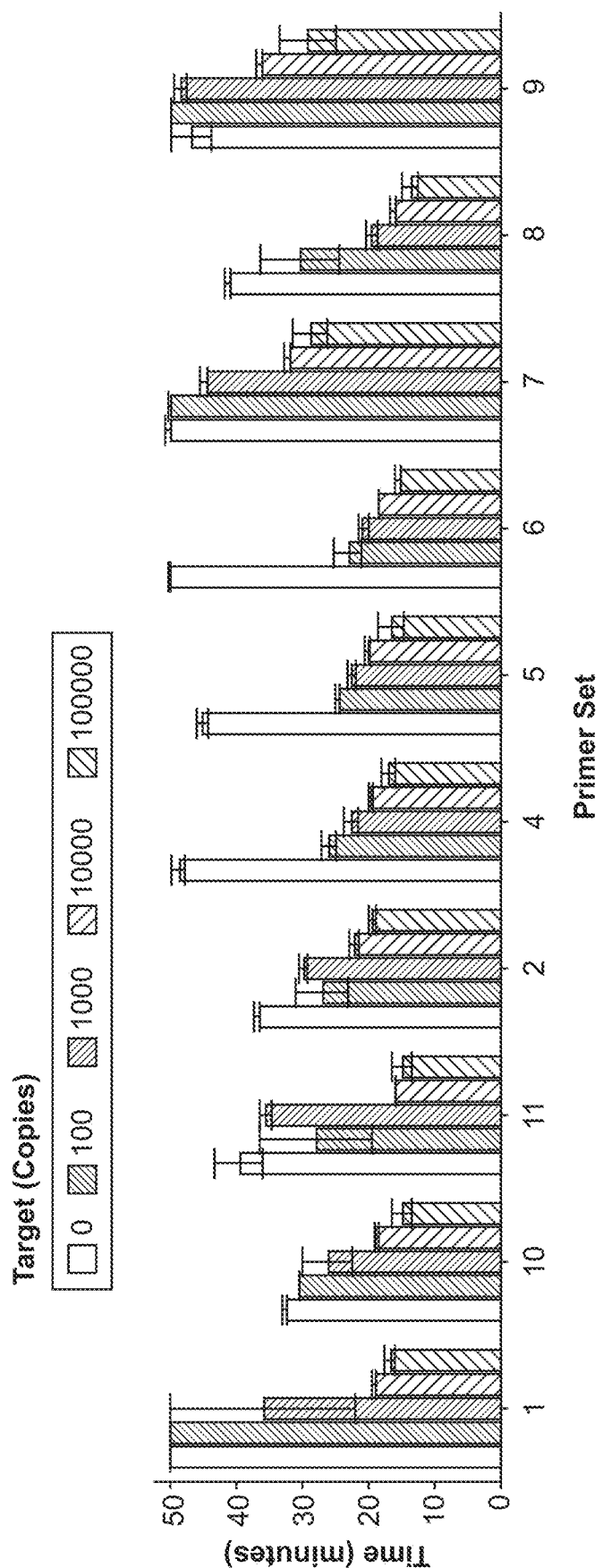

FIG. 48 shows the time to amplification of an IAV target sequence following LAMP amplification with different primer sets.

Figure 49:
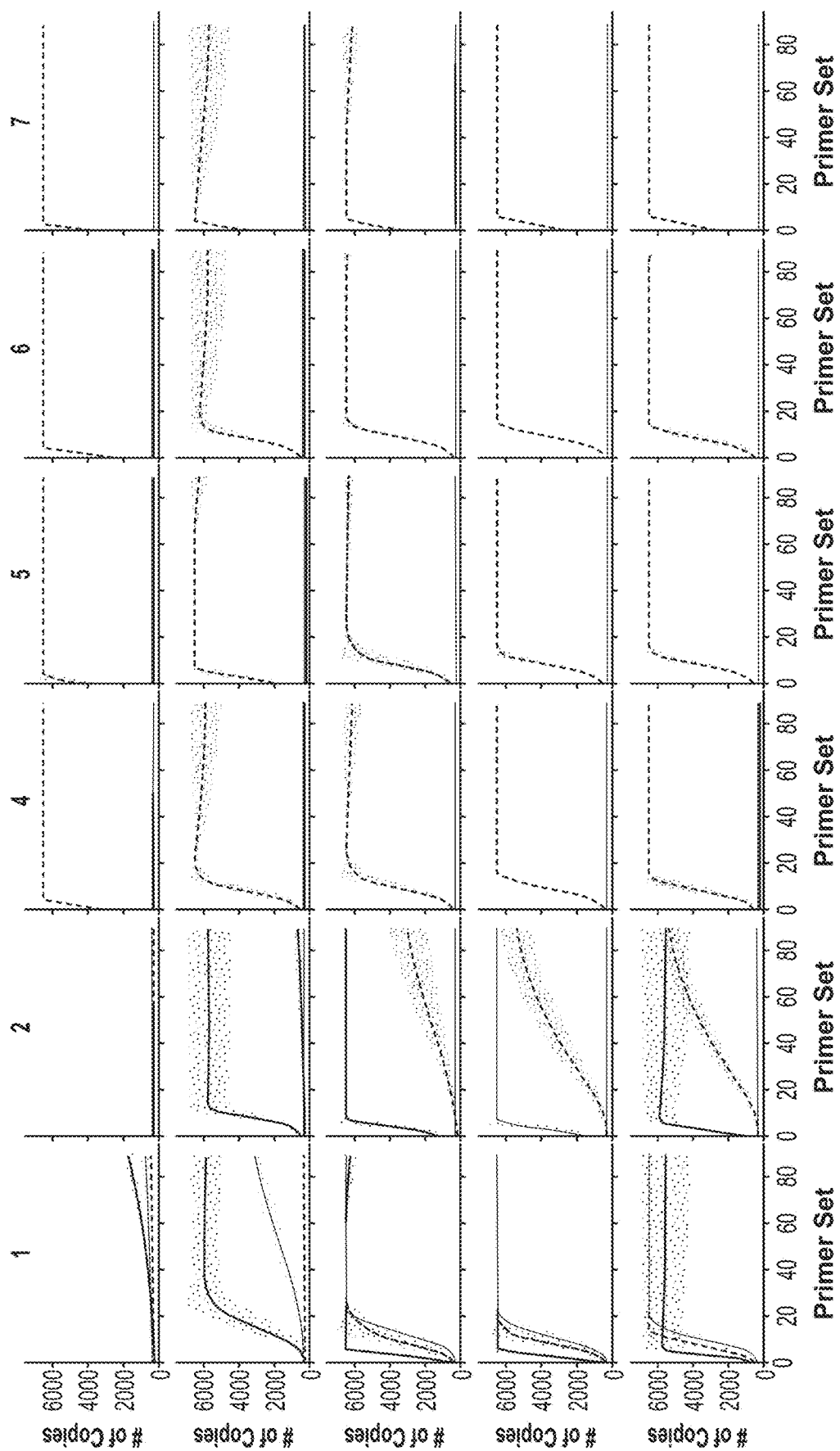
Figure 49:
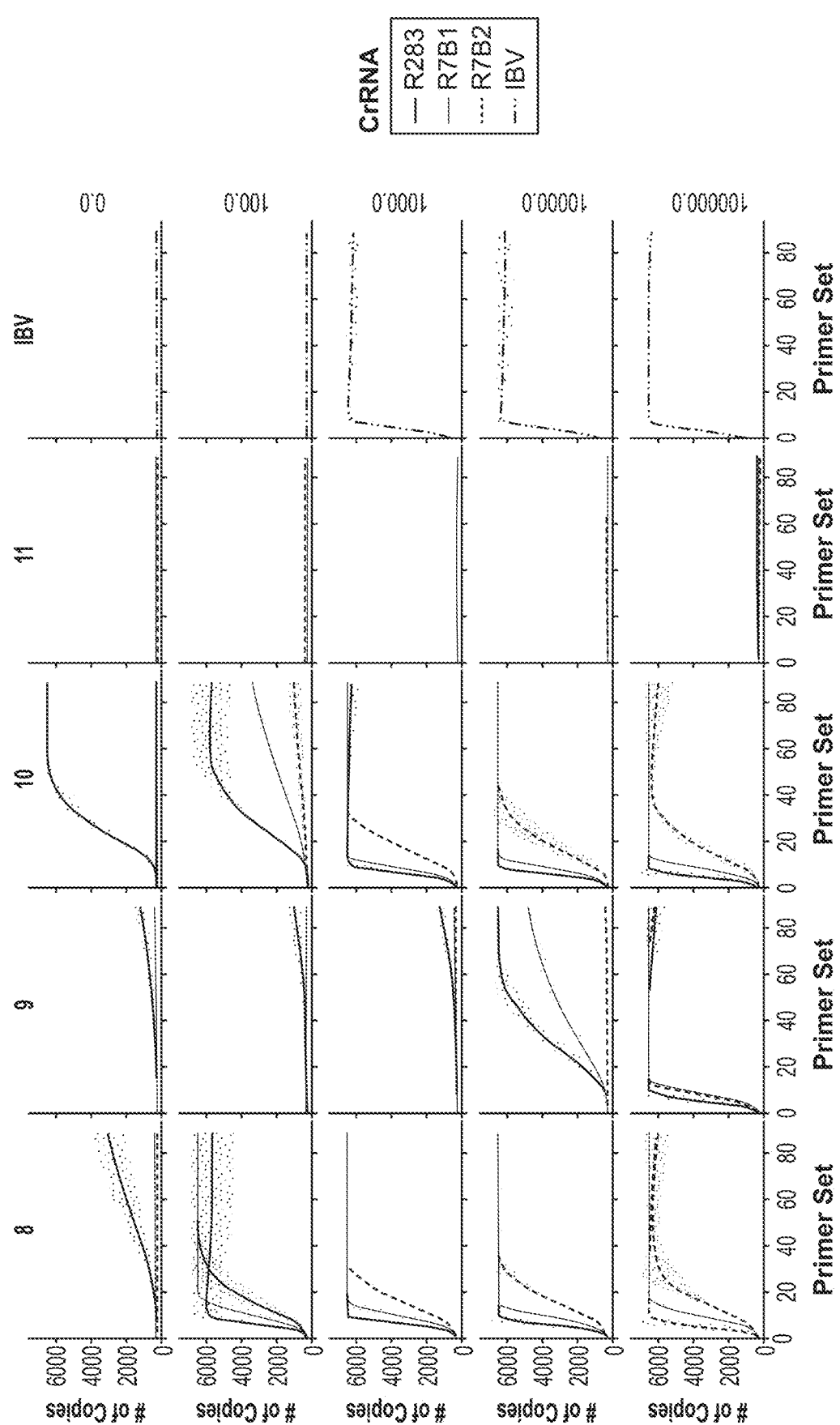

FIG. 49 shows detection of target nucleic acid sequences from influenza A virus (IAV) using DETECTR following RT-LAMP amplification with LAMP primer sets 1, 2, 4, 5, 6, 7, 8, 9, 10, 11, or a negative control. Ten reactions were performed per primer set. DETECTR signal was measured as a function of an amount of target sequence present in the reaction. Sequences of the primer sets are provided in TABLE 12.

Figure 50:
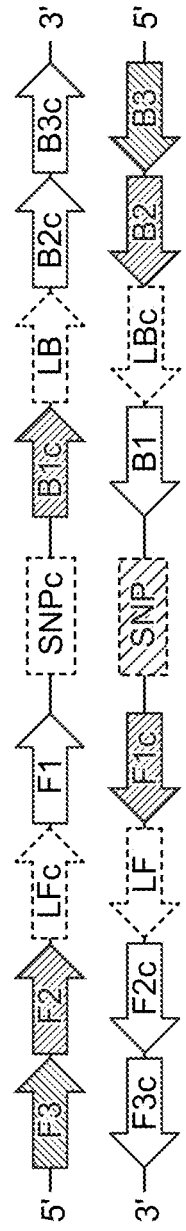
Figure 50:
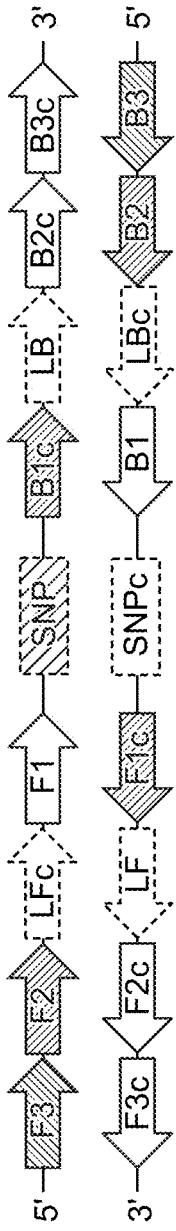

FIG. 50 shows a scheme for designing primers for LAMP amplification of a target nucleic acid sequence and detection of a single nucleotide polymorphism (SNP) in the target nucleic acid sequence. In an exemplary arrangement, the SNP of the target nucleic acid is positioned between the F1c region and the B1 region.

FIG. 51 shows schematics of exemplary arrangements of LAMP primers, guide RNA sequences, protospacer-adjacent motif (PAM) or protospacer flanking site (PFS), and target nucleic acids with a SNP for methods of LAMP amplification of a target nucleic acid and detection of the target nucleic acid using DETECTR.

Figure 51A:
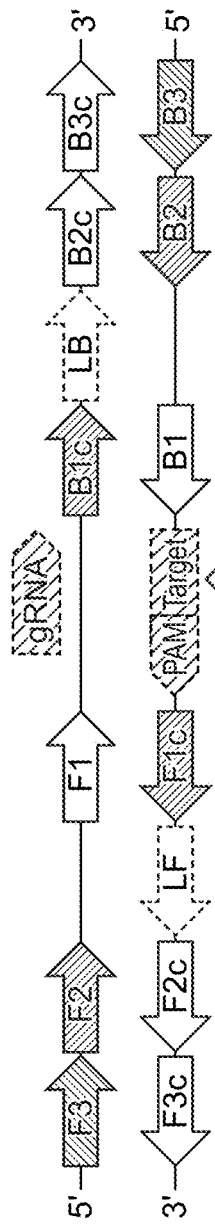

FIG. 51A shows a schematic of an exemplary arrangement of the guide RNA with respect to various regions of the nucleic acid sequence that correspond to or anneal LAMP primers. In this arrangement, the PAM or PFS of the target nucleic acid is positioned between an F1c region and a B1 region. The entirety of the guide RNA sequence may be between the F1c region and the B1c region. The SNP is shown as positioned within a sequence of the target nucleic acid that hybridizes to the guide RNA.

Figure 51B:
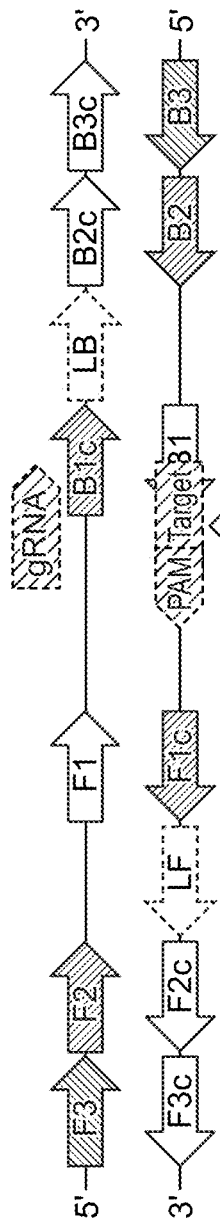

FIG. 51B shows a schematic of an exemplary arrangement of the guide RNA sequence with respect to various regions of the nucleic acid sequence that correspond to or anneal LAMP primers. In this arrangement, the PAM or PFS of the target nucleic acid is positioned between an F1c region and a B1 region and the target nucleic acid comprises a sequence between an F1c region and a B1 region that is reverse complementary to at least 60% of a guide nucleic acid. In this example, the guide RNA is not reverse complementary to the forward inner primer or the backward inner primer. The SNP is shown as positioned within a sequence of the target nucleic acid that hybridizes to the guide RNA.

Figure 51C:
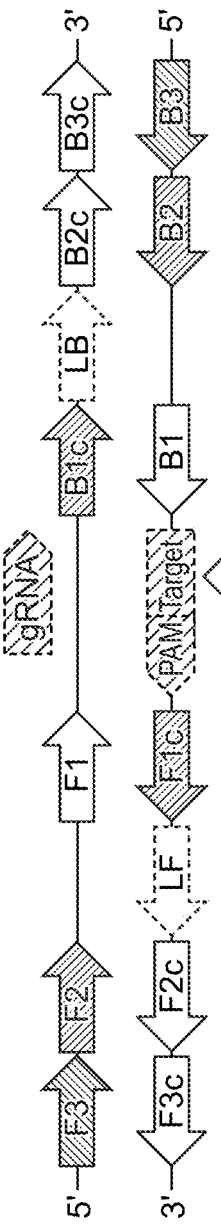

FIG. 51C shows a schematic of an exemplary arrangement of the guide RNA sequence with respect to various regions of the nucleic acid sequence that correspond to or anneal LAMP primers. In this arrangement, the PAM or PFS of the target nucleic acid is positioned between the F1c region and the B1 region and the entirety of the guide RNA sequence is between the F1c region and the B1 region. The SNP is shown as positioned within a sequence of the target nucleic acid that hybridizes to the guide RNA.

Figure 52:
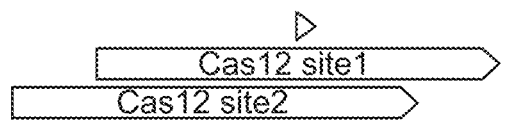

FIG. 52 shows an exemplary sequence of a nucleic acid comprising two PAM sites and a HERC2 SNP. The positions of two gRNAs targeting the HERC2 A SNP allele at either position 9 with respect to a first PAM site (SEQ ID NO: 245) or at position 14 with respect to a second PAM site (SEQ ID NO: 247) are shown. The position of a SNP is indicated with a triangle.

Figure 53:
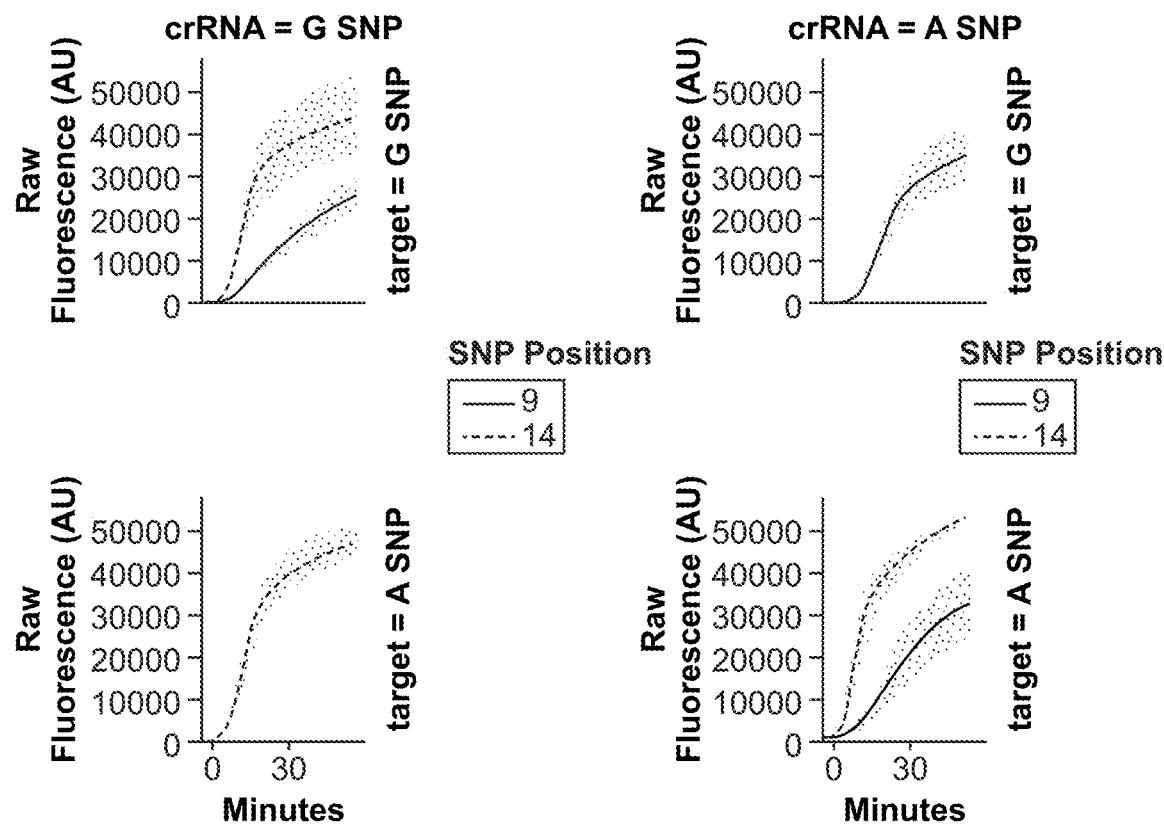

FIG. 53 shows results from DETECTR reactions to detect a HERC2 SNP at position 9 with respect to a first PAM site or position 14 with respect to a second PAM site following LAMP amplification. Fluorescence signal, indicative of detection of the target sequence, was measured over time in the presence of a target sequence comprising either a G allele or an A allele in HERC2. The target sequence was detected using a guide RNA (crRNA only) to detect either the A allele or the G allele (SEQ ID NO: 245-SEQ ID NO: 248).

Figure 54:
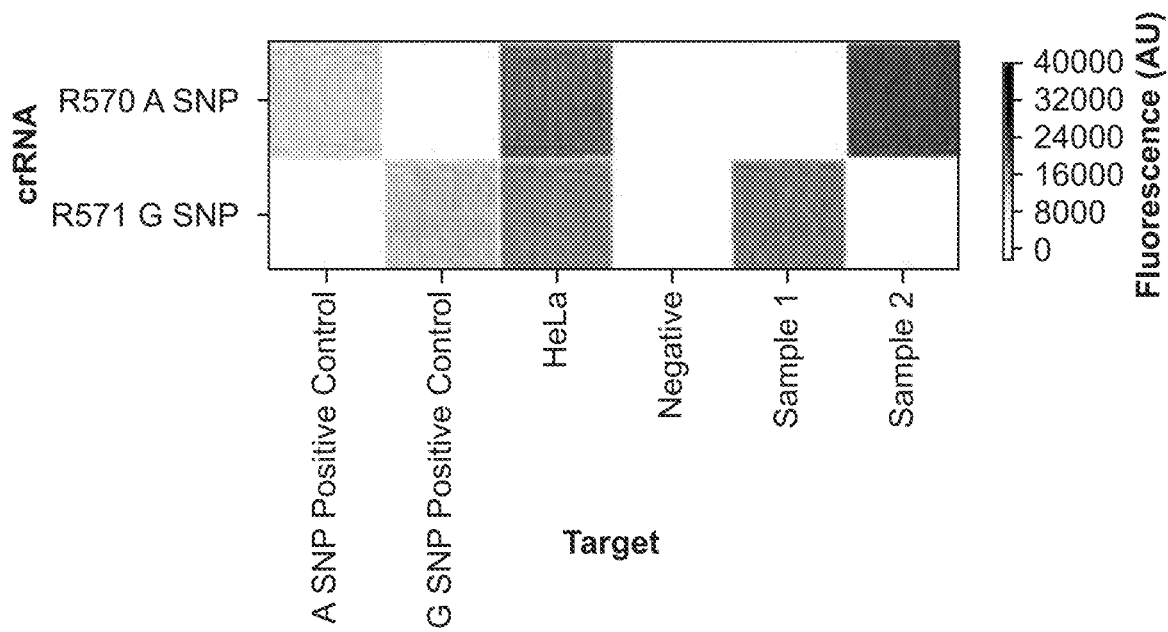

FIG. 54 shows a heatmap of fluorescence from a DETECTR reaction following LAMP amplification of the target nucleic acid sequence. The DETECTR reaction differentiated between two HERC2 SNP alleles at position 9 with respect to the PAM, using guide RNAs (crRNA only) specific for the A allele (SEQ ID NO: 245, "R570 A SNP") or the G allele (SEQ ID NO: 246, "R571 G SNP"). Positive detection is indicated by a high fluorescence value in the DETECTR reaction.

Figure 55:
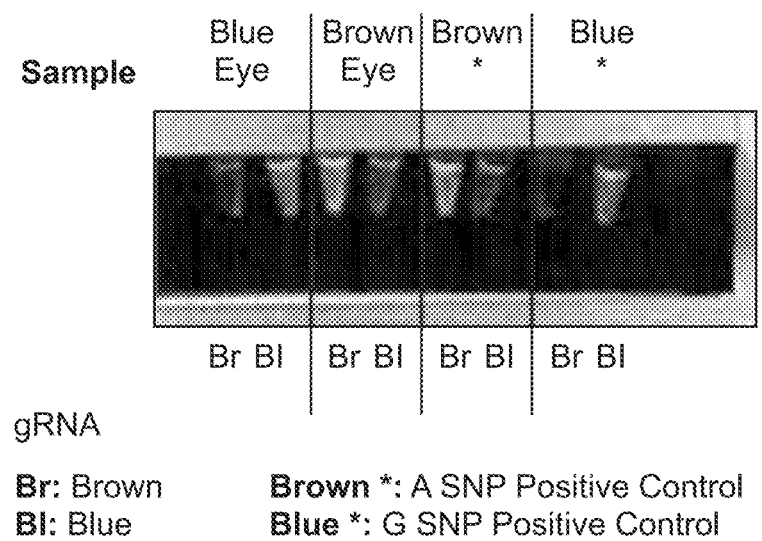
Figure 56A:
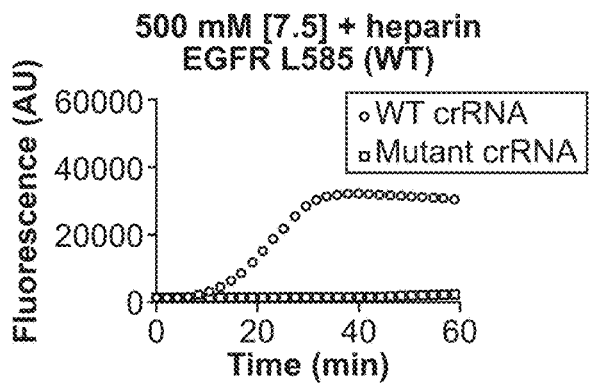
Figure 56B:
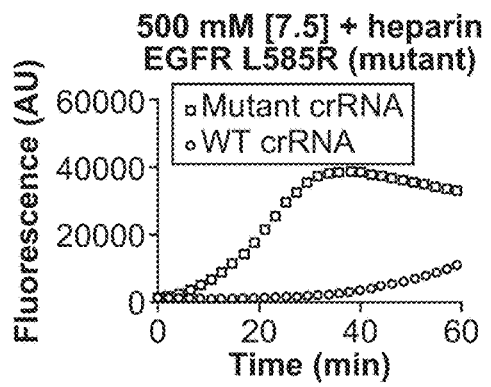
Figure 56C:
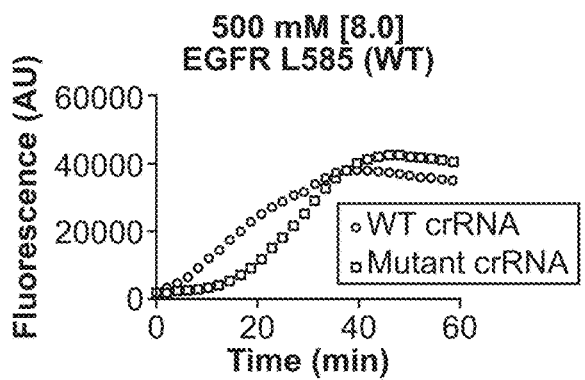
Figure 56D:
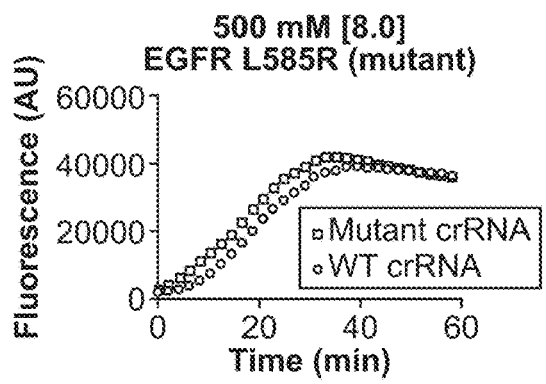
Figure 56E:
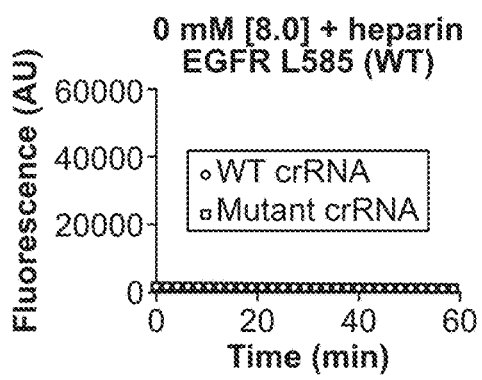
Figure 56F:
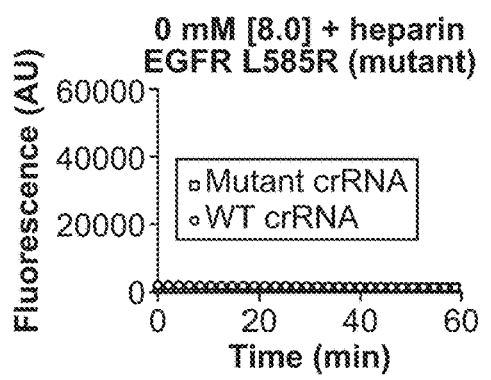
Figure 56G:
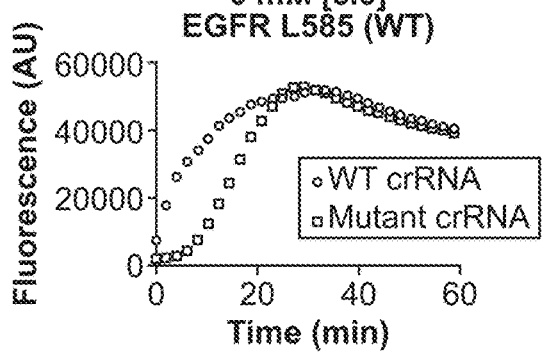
Figure 56H:
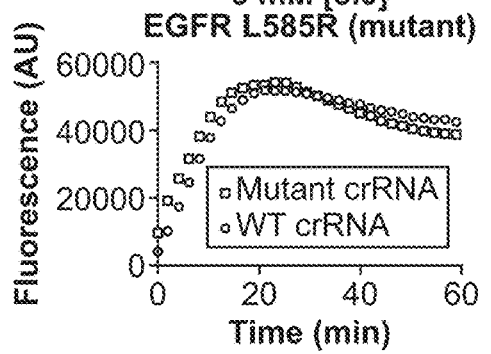

FIG. 55 shows combined LAMP amplification of a target nucleic acid by LAMP and detection of the target nucleic acid by DETECTR. Detection was carried out visually with DETECTR by illuminating the samples with a red LED. Each reaction contained a target nucleic acid sequence comprising a SNP allele for either a blue eye phenotype ("Blue Eye") or a brown eye phenotype ("Brown Eye"). Samples "Brown *" and "Blue *" were an A allele positive control and a G allele positive control, respectively. A position 9 guide RNA for either the brown eye phenotype (SEQ ID NO: 245, "Br") or the blue eye phenotype (SEQ ID NO: 246, "Bl") was used for each LAMP DETECTR reaction.

FIG. 56A, FIG. 56B, FIG. 56C, FIG. 56D, FIG. 56E, FIG. 56F, FIG. 56G, and FIG. 56H show high sensitivity and high specificity buffers for LbCas12a (SEQ ID NO: 1). In the presence of 50 µg/ml heparin and 100 mM salt, LbCas12a has improved targeting specificity and enhanced SNP discrimination capabilities. Target sequences were detected using a crRNA directed to the EGFR wild type sequence (SEQ ID NO: 448, UAAUUUCUACUAAGUGUA-GAUGGCUGGCCAAACUGCUGGGU) or a crRNA directed to the EGFR mutant sequence (G SNP, SEQ ID NO: 449, UAAUUUCUACUAAGUGUAGAUGGCGGGC-CAAACUGCUGGGU). In the absence of heparin and salt, Cas12a has improved sensitivity. For all SNP-related studies, high specificity buffer was used.

Figure 57:
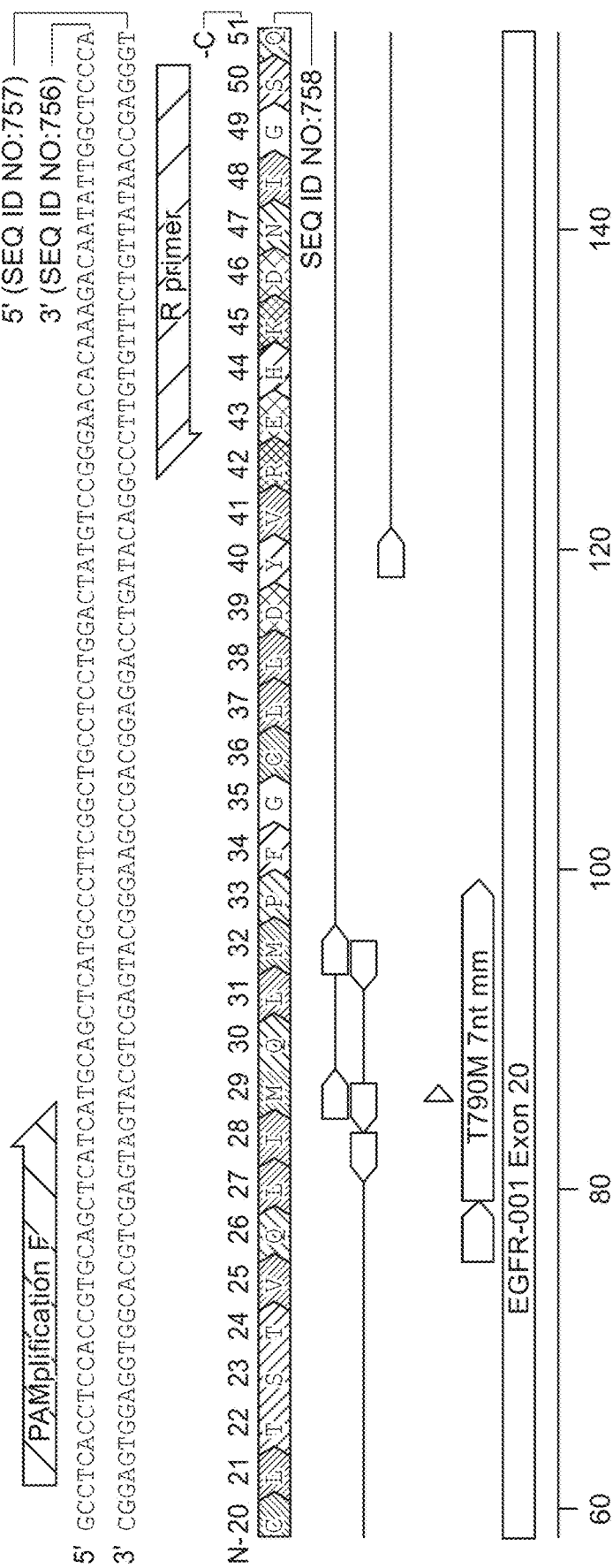

FIG. 57 shows a schematic of PCR primers and guide RNA targeting sequence for EGFR T790M SNP. The forward primer represents a "PAMplification primer" (SEQ ID NO: 396), which embeds a PAM sequence ('TTTV') upstream of the targeting sequence and includes a 6 nt 3' extension for priming. The PAM sequence is required for Cas12a-gRNA to recognize the matching DNA target. In this schematic, the guide RNA is designed to target the mismatch located 7 nucleotides (nt) downstream of the 5' end of the target sequence (SEQ ID NO: 400). This guide RNA/primer design is used for FIG. 59-FIG. 61.

FIG. 58A, FIG. 58B, and FIG. 58C show the PAM forward (F) primer (also referred to as a PAMplification primer) used in amplification. PAM F primers with varying 3' extensions (4 nt, 5 nt, 6 nt, SEQ ID NO: 394, SEQ ID NO: 395, and SEQ ID NO: 396, respectively) were tested with guide RNA targeting T790M with mismatch at the 7th position (SEQ ID NO: 400). The PAM F primer with 6 nt extension (SEQ ID NO: 396) demonstrated optimal detection with the guide RNA. This PAM F primer was used for FIG. 60-FIG. 63. The PAMplification primer produces dU-containing amplicons for detection of mutant sequences at low frequency. Cas12 guide RNAs were designed to target the T790M mutant allele (c.2369C>T, at guide mismatch position 7) in Horizon Discovery EGFR cfDNA standards at 0-5% minor allele frequencies (MAF) with 2 ng input DNA. PAMplification primers include 4-6 nt extensions at the 3' end downstream of the embedded PAM. n=3 technical replicates; bars represent mean±SD.

FIG. 59A-FIG. 59C illustrate that Cas12 guide RNAs designed to target a wild type sequence ("WT" C SNP allele) and sequence comprising a T790M T SNP allele show specific Cas12-based detection in the presence of cognate single nucleotide polymorphism (SNP). Targets were detected with a crRNA directed to the wild type sequence (SEQ ID NO: 423) or a crRNA directed to the T SNP allele sequence (SEQ ID NO: 439). Time courses show activation of the WT or mutant crRNA only in the presence of the matching target (FIG. 59A and FIG. 59B). Heatmap represents time course data at t=60 min (FIG. 4C) n=3 technical replicates; synthetic oligo targets; bars represent mean±SD.

Figure 60C:
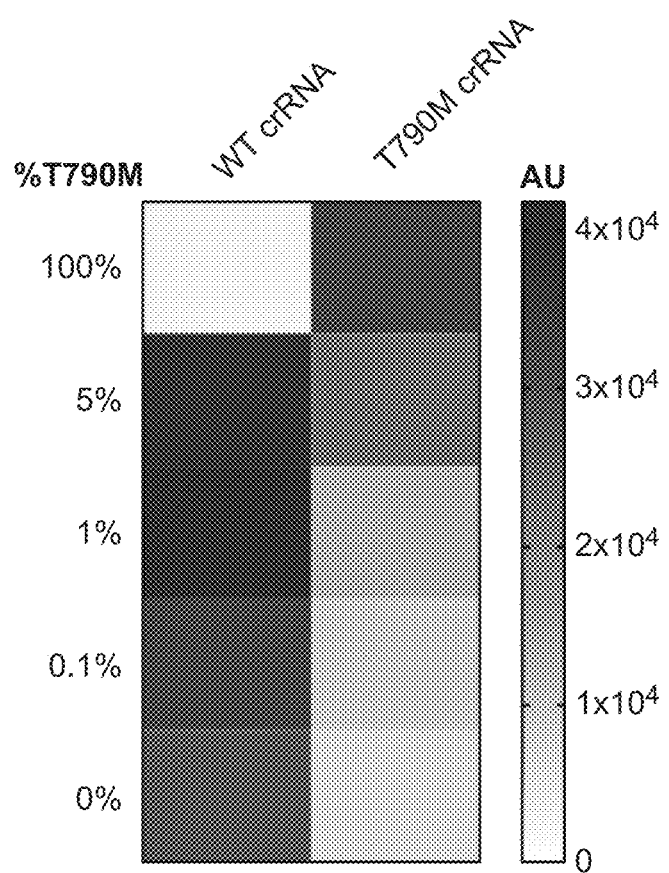
Figure 60D:
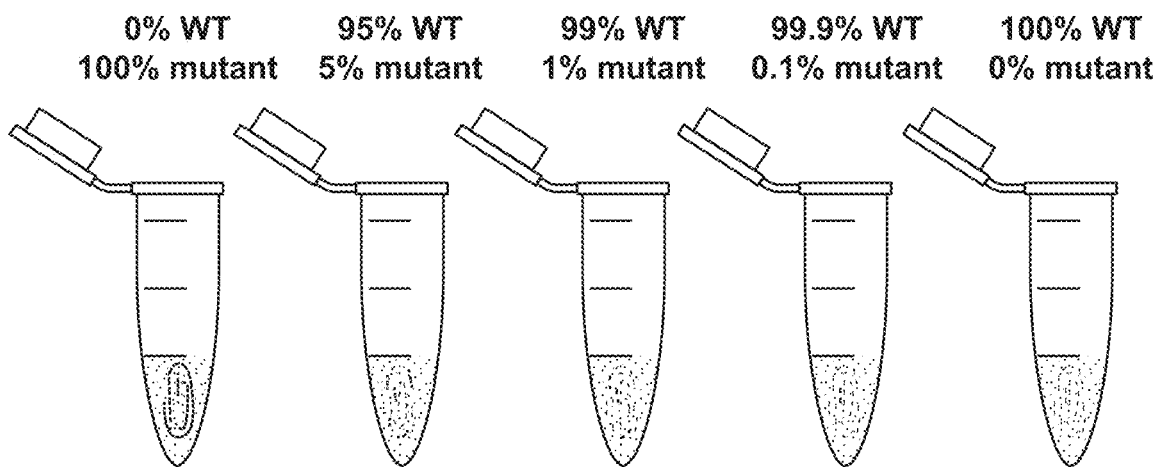

FIG. 60A-FIG. 60D show Cas12a can detect down to 0.1-1% minor allele frequency (MAF) of EGFR T790M (T SNP allele) in mock cfDNA samples (Horizon Discovery), with 2 ng total DNA input and a PCR pre-amplification step. Targets were detected with a crRNA directed to the wild type sequence (SEQ ID NO: 423) or a crRNA directed to the T SNP allele sequence (SEQ ID NO: 439). Detection of WT (C SNP allele) and mutant allele at t=90 min with low frequency EGFR standards (FIG. 60A). Bar graphs of mutant allele detection only (FIG. 60B). Heatmap representation of WT and mutant allele detection (FIG. 60C). The detection of low frequency SNPs using PAMplification with 6 nt extension and dU-containing amplicons. Cas12a can detect down to 0.1-1% minor allele frequency (MAF) of EGFR T790M in mock cfDNA samples (Horizon Discovery), with 2 ng total DNA input. n=3 replicates, two-tailed Student's t-test; *p<0.05, p<0.01, *p<0.001, ****p<0.0001; bars represent mean plus SD. FIG. 60D shows the different percentages of the WT and mutant allele in sample in a single test tube as pictorial representation of the percentage of MAF in the samples tested.

Figures 61, 62:
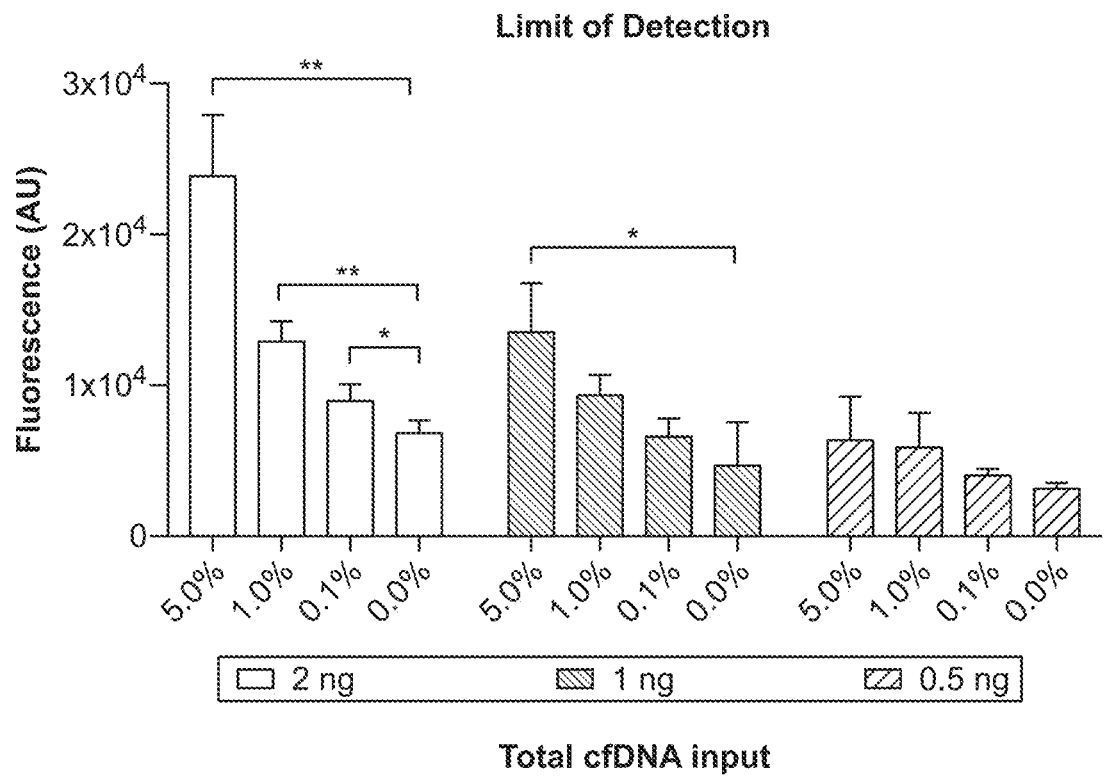

FIG. 61 shows limit of detection studies illustrating that 2 ng total DNA is the minimum input allowed for detection of 0.1-1% minor allele frequency (MAF) of EGFR T790M (T SNP allele) in mock cfDNA samples (Horizon Discovery) with a PCR pre-amplification step. n=3 replicates, two-tailed Student's t-test; *p<0.05, p<0.01, *p<0.001, ****p<0.0001; bars represent mean plus SD. Targets were detected using a crRNA directed to T SNP allele (SEQ ID NO: 403). Targets were amplified using primers corresponding to SEQ ID NO: 396 and SEQ ID NO: 397.

FIG. 62 shows a table of FIG. 61 assay parameters.

FIG. 63A-FIG. 63D show a blocking primer strategy.

FIG. 63A shows how the blocking primer blocks the forward primer from binding to the WT nucleic acid for amplification.

FIG. 63B shows how the mutation in SNP does not result in the binding of the blocking primer, and therefore allowing the forward primer to bind to the SNP nucleic acid for amplification.

Figure 64A:
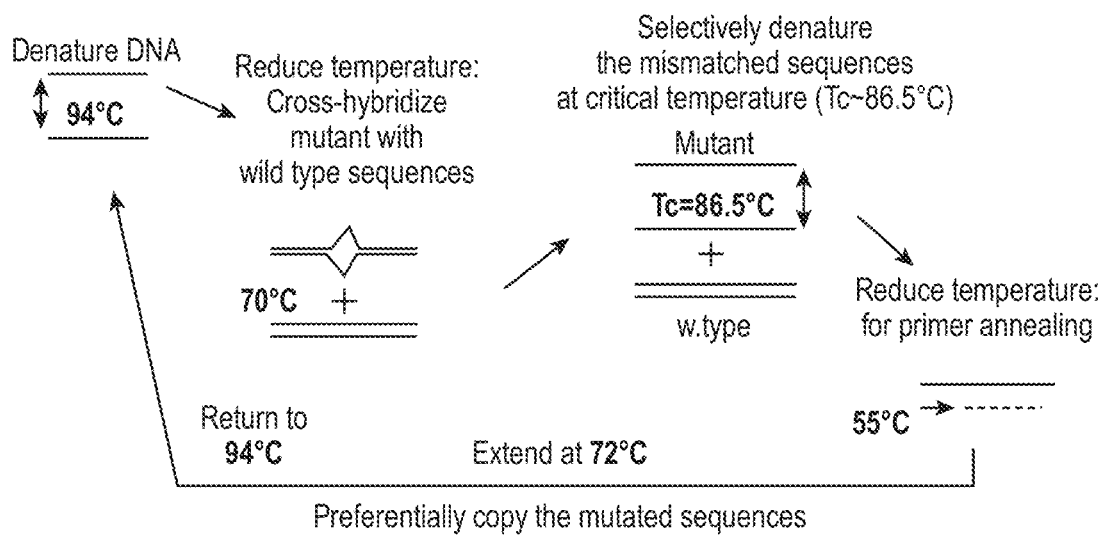
Figure 64B:
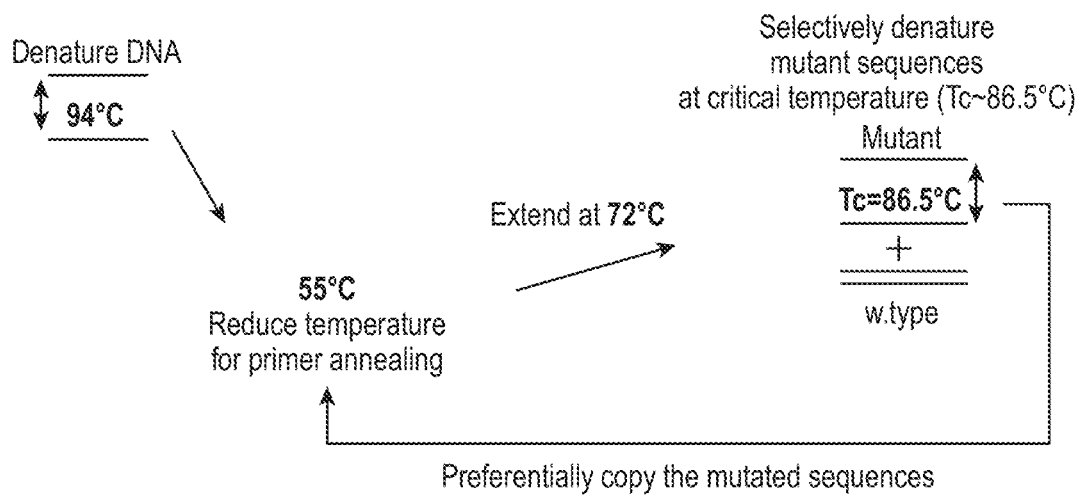

FIG. 63C and FIG. 63D show the detection of the EGFR C SNP using an input of 6 ng and the detection of the EGFR T SNP using an input of 6 ng, respectively, after amplification using the blocking primer strategy of FIG. 64A and FIG. 64B. PAMplification and blocking primers are provided in TABLE 16.

FIG. 64A-FIG. 64B and FIG. 65A-FIG. 65B illustrate COLD-PCR strategies. FIG. 64A shows a full COLD-PCR strategy. FIG. 64B shows a fast COLD-PCR strategy.

Figure 65A:
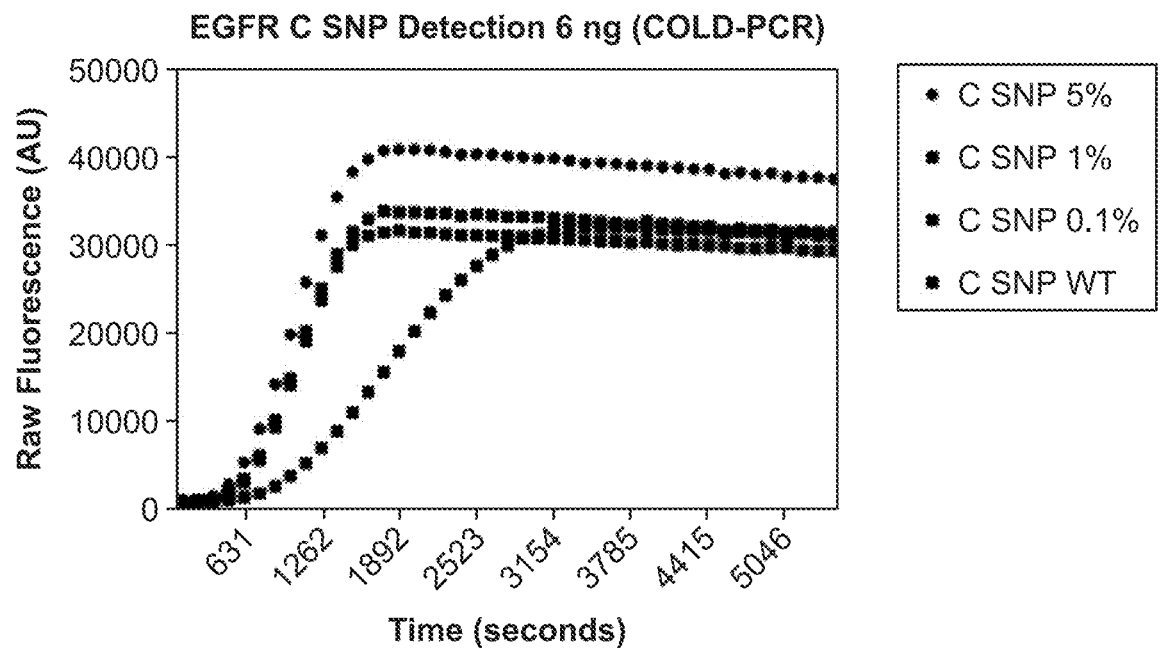
Figure 65B:
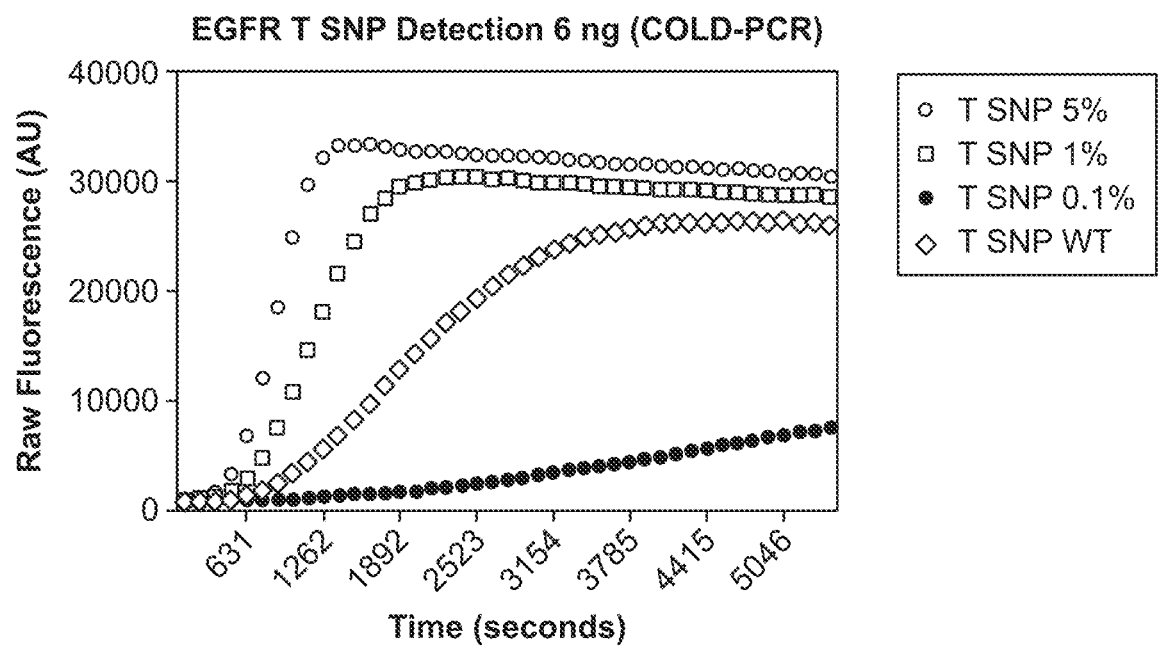

FIG. 65A shows the detection of the EGFR C SNP using an input of 6 ng and a crRNA corresponding to SEQ ID NO: 423 and LbCas12a (SEQ ID NO: 1) after amplification using COLD-PCR. FIG. 65B shows the detection of the EGFR C SNP using an input of 6 ng the detection of the EGFR T SNP using an input of 6 ng and a crRNA corresponding to SEQ ID NO: 439 and LbCas12a (SEQ ID NO: 1) after amplification using COLD-PCR. COLD-PCR was performed using primers corresponding to SEQ ID NO: 396 and SEQ ID NO: 397.

Figure 66A:
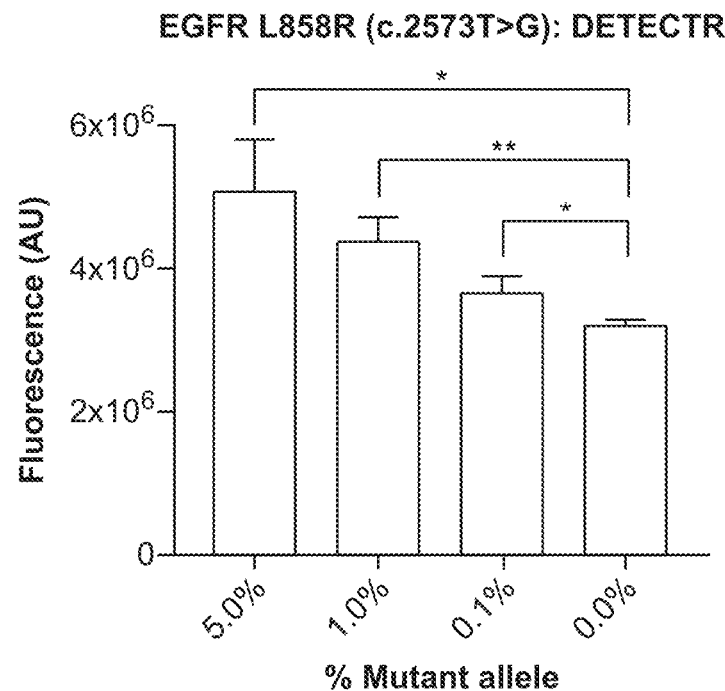
Figure 66B:
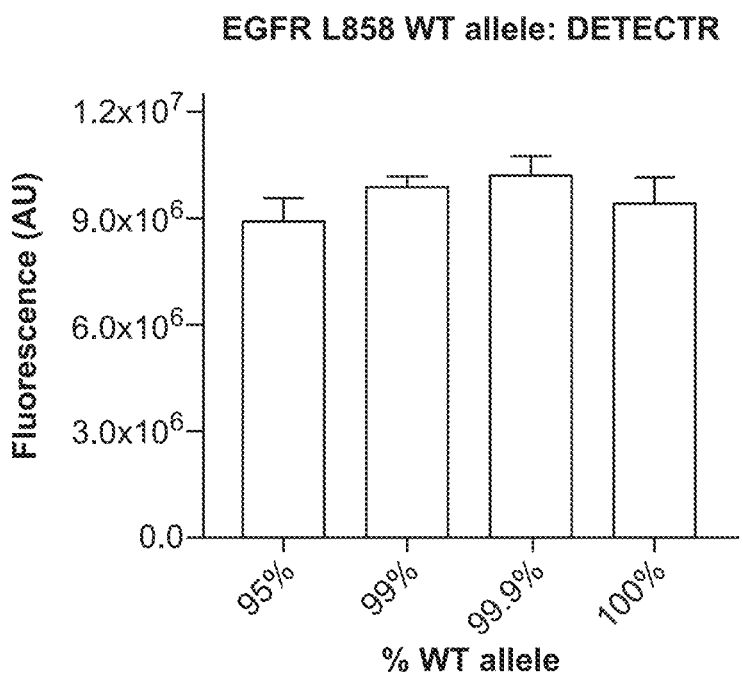

FIG. 66A-FIG. 66B show experimental data illustrating that LbCas12a (SEQ ID NO: 1) can detect as low as 0.1% minor allele frequency (MAF) of EGFR L858R G SNP allele in synthetic DNA samples (Gblock), with a 1 nM total DNA input and a cold-PCR pre-amplification step. FIG. 66A shows detection of the mutant allele using a gRNA corresponding to SEQ ID NO: 429 and FIG. 66B shows detection of the WT allele using a gRNA corresponding to SEQ ID NO: 430 at t=40 minutes. (n=3 replicates, two-tailed Student's t-test; bars represent mean plus SD). Target sequences were amplified using primers corresponding to SEQ ID NO: 450 (GGCAGCCAGGAACGTACTG) and SEQ ID NO: 451 (CCTTCTGCATGGTATTCTTTCTCTTCC).

Figure 67:
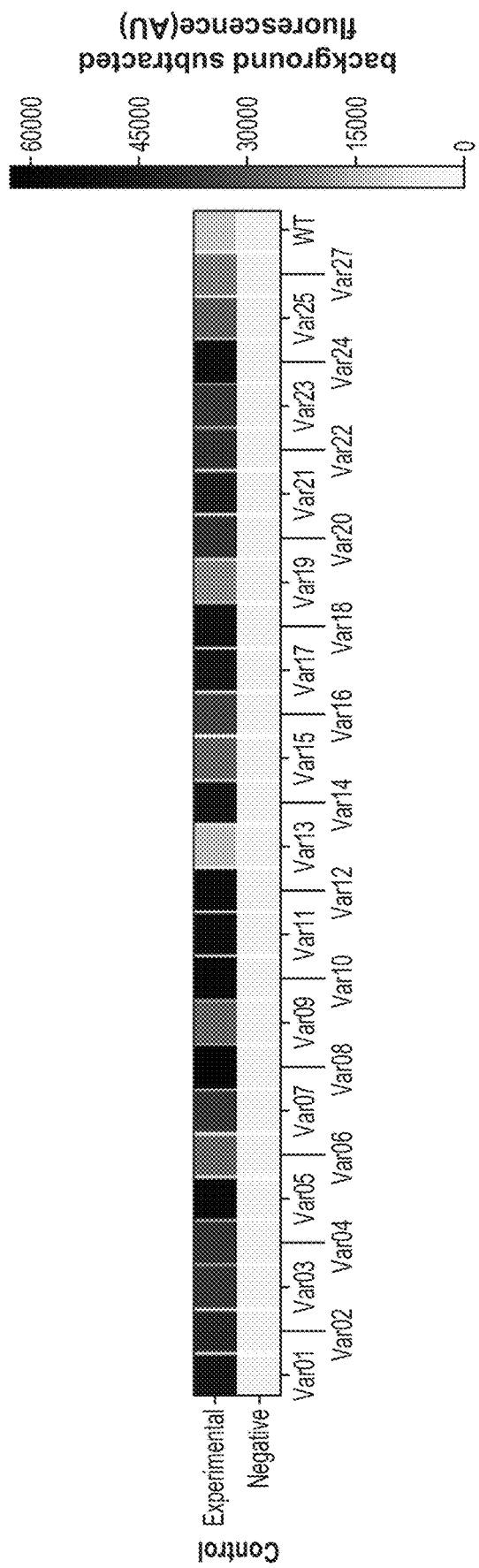
Figure 68A:
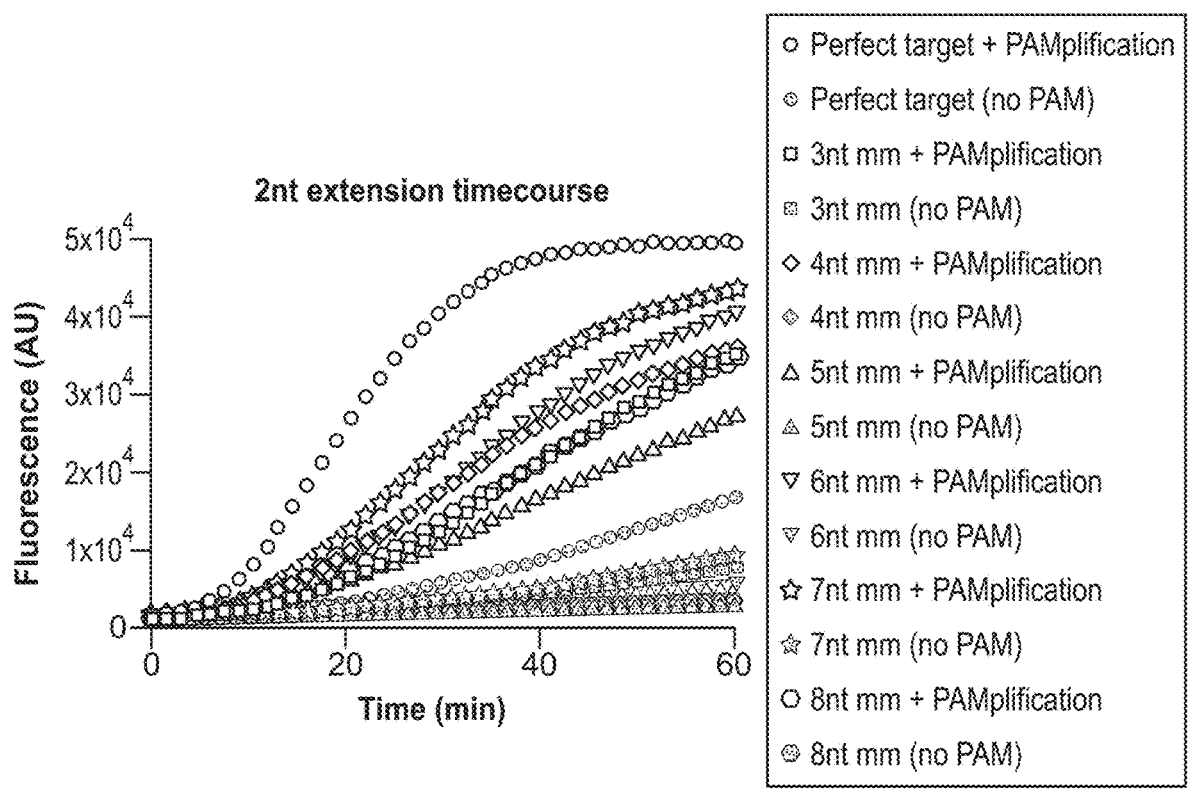
Figure 68B:
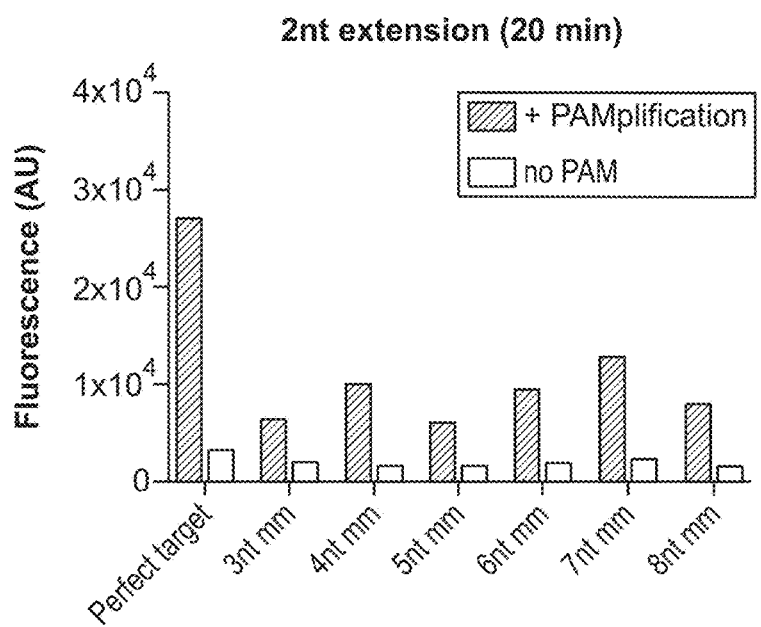
Figure 69A:
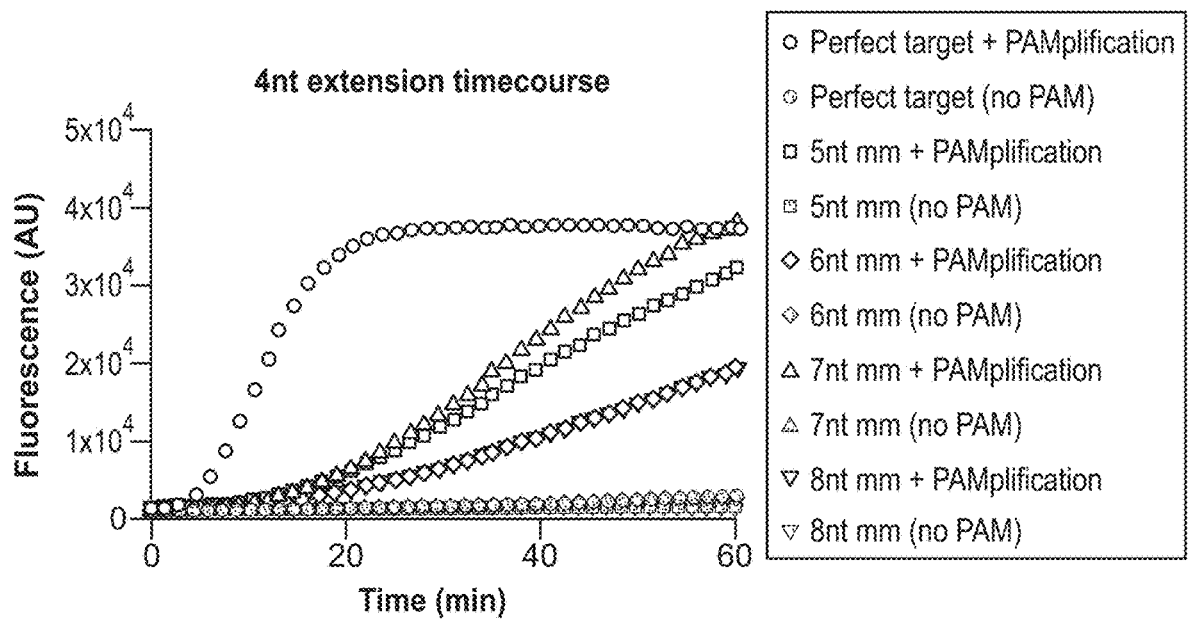
Figure 69B:
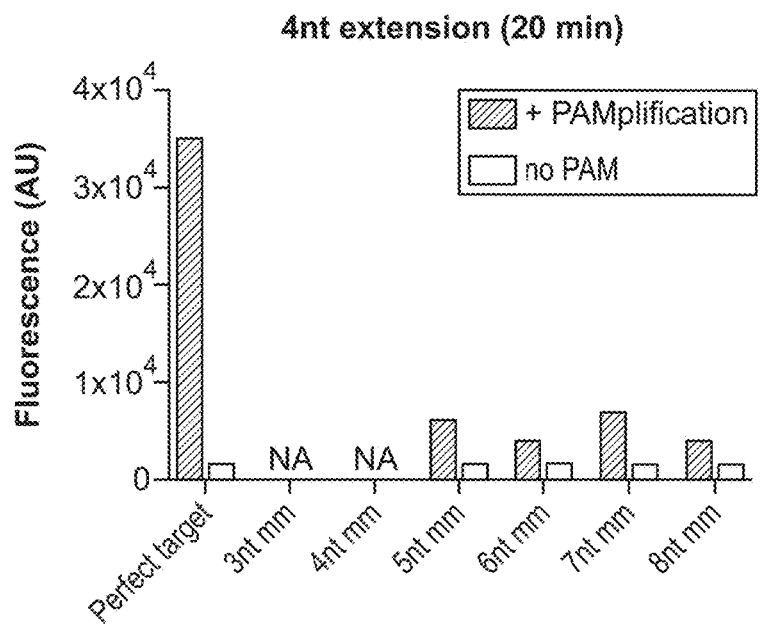

FIG. 67 shows the results of an EGFR exon 19 deletion Guide Screen using LbCas12a (SEQ ID NO: 1). Twenty-six guides corresponding to SEQ ID NO: 480-SEQ ID NO: 506 were designed and screened on 1 nM synthetic DNA (Twist fragments). Two guides (SEQ ID NO: 493 and SEQ ID NO: 499) yielded DETECTR signals similar to wild-type. The remaining 24 guides showed activity greater than wild-type with three standing out with the highest DETECTR activity (SEQ ID NO: 485, SEQ ID NO: 488, and SEQ ID NO: 490). Targets corresponding to SEQ ID NO: 452-SEQ ID NO: 477 and SEQ ID NO: 479 were detected. Target sequences are provided in TABLE 21.

FIG. 68A-FIG. 68B and FIG. 69A-FIG. 69B show the PAM forward primer (also referred to as a PAMplification primer). The single nucleotide mismatch was anchored at positions 3-8 or 5-8 nt downstream of the PAM. PAMplification primers with 2 nt or 4 nt extensions at the 3' end were tested for their ability to discriminate the non-cognate target containing a single nucleotide mismatch/polymorphisph (SNP). Here, a 4 nt PAMplification 3' extension is better at SNP detection compared to the 2 nt extension. The mismatch position is optimal around positions 6 ("6 nt mm"), 7 ("7 nt mm") or 8 ("8 nt mm"). Primers used in this assay are provided in TABLE 22. Targets were detected using LbCas12a (SEQ ID NO: 1) and a gRNA corresponding to SEQ ID NO: 264 (UAAUUUCUACUAAGUGUA-GAUAACUUGACAUUUAAUGCUCA).

Figure 70A:
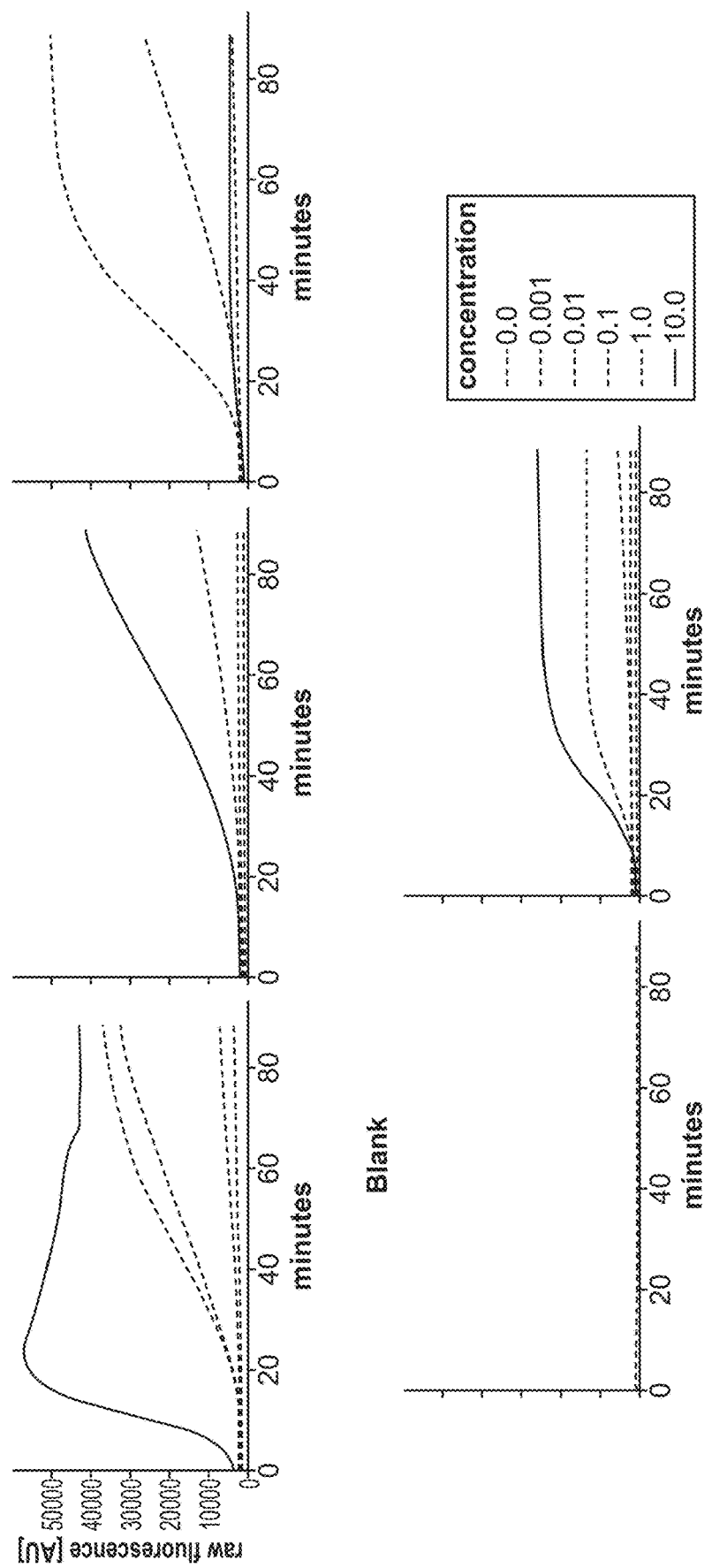
Figure 70B:
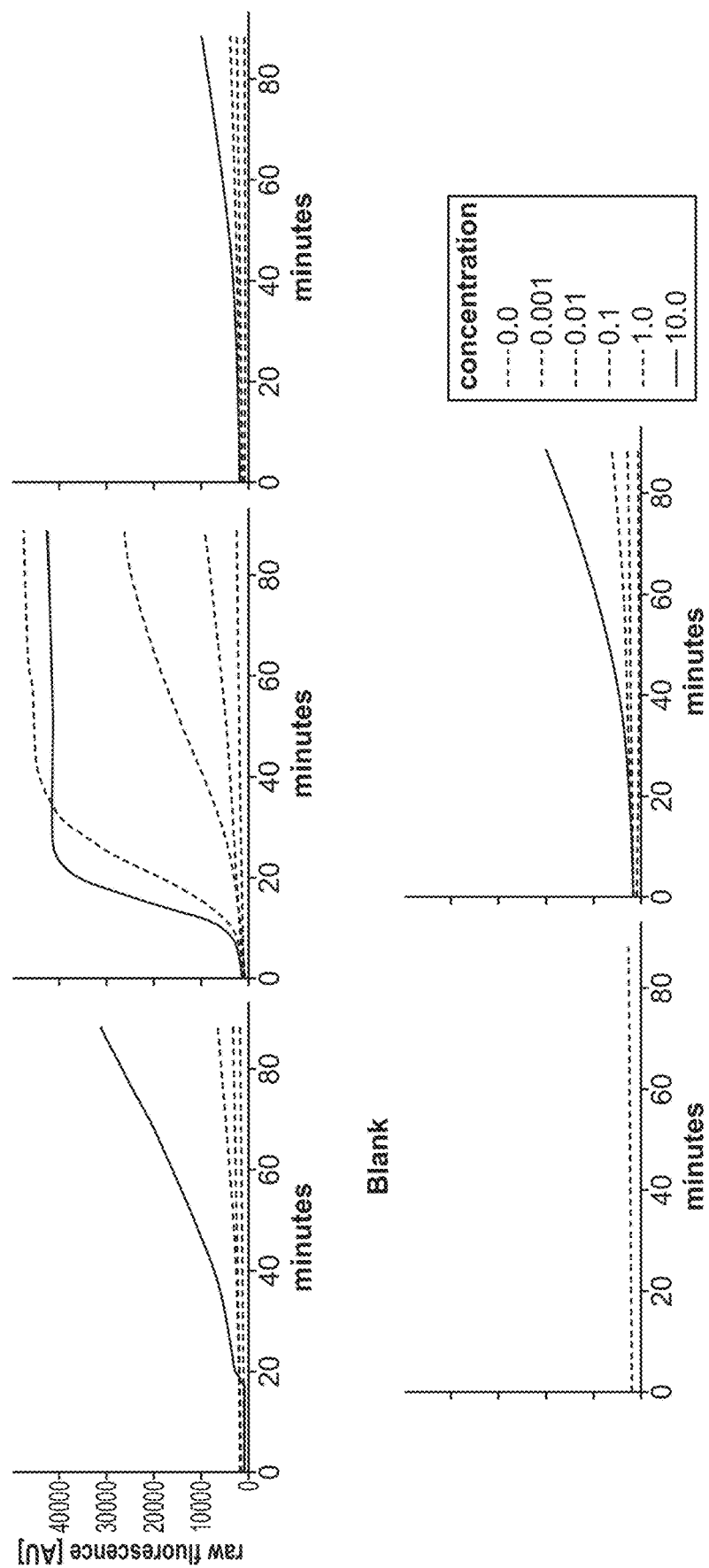

FIG. 70A-FIG. 70B show that Cas12 recognizes dU-containing PAM and target sequences from 100 nM to 10 pM. FIG. 70A: WT SNP-targeting guide RNA; FIG. 70B: mutant SNP-targeting guide RNA. Left to right for both FIG. 70A and FIG. 70B: (top left) WT sequence with dT-containing target, (top middle) mutant sequence with dT-containing target, (top right) mutant sequence with dU-containing PAM and target, (bottom left) no target, (bottom right)

mutant sequence with dT-containing PAM and dU-containing target. Cas12 (SEQ ID NO: 1) is capable of SNP detection with dU-containing sequences (both PAM and target) without compromising sensitivity. Primers used in this assay are provided in TABLE 22.

Figure 71A:
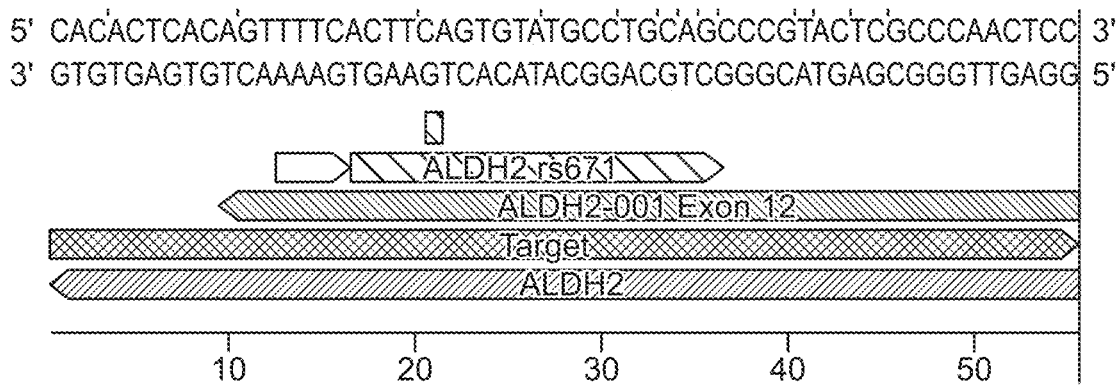
Figure 71B:
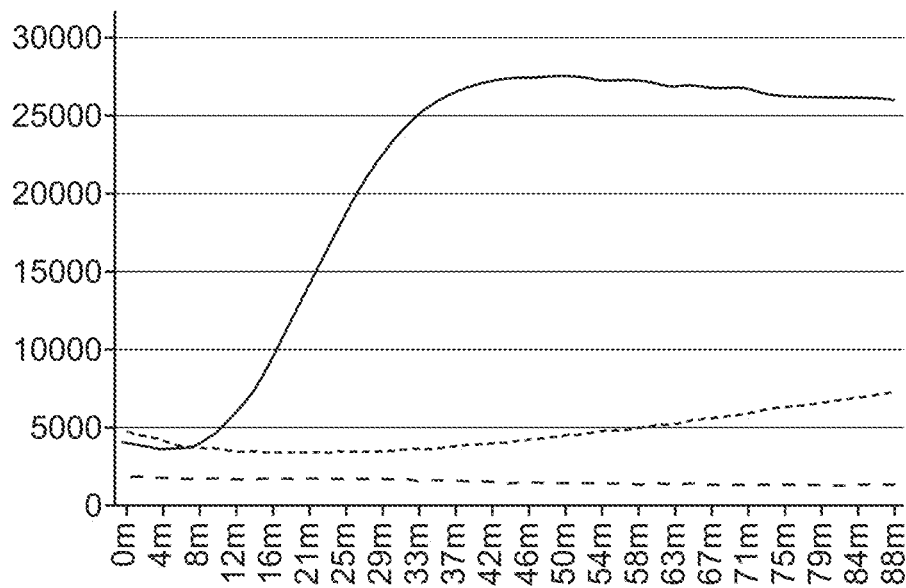

FIG. 71A-FIG. 71B show the detection of ALDH2 WT allele from human genomic DNA (SEQ ID NO: 417) with dU-containing amplicons with Cas12. The ALDH2 gene was amplified from human saliva containing the WT allele using Taq master mix containing dUTP in place of dTTP, such that all T nucleotides with the annotated ALDH2 target sequence shown in FIG. 71A have been replaced by U nucleotides. The amplicon was added directly to a Cas12 DETECTR assay. Cas12 guide RNAs targeting the ALDH2 WT allele detected only the cognate WT sequence and not the mutant allele, demonstrating that Cas12 is capable of SNP detection with dU-containing targets. Figure discloses SEQ ID NOS 752-753, respectively, in order of appearance. FIG. 71B shows a DETECTR reaction of an ALDH2 target nucleic acid sequence amplified with dUTPs using LbCas12a (SEQ ID NO: 1). Fluorescence was measured over time in the presences of the wild type nucleic acid sequence ("WT SNP"), a sequence with a point mutation ("Mutant SNP"), or a negative control without the target nucleic acid sequence.

Figure 72:
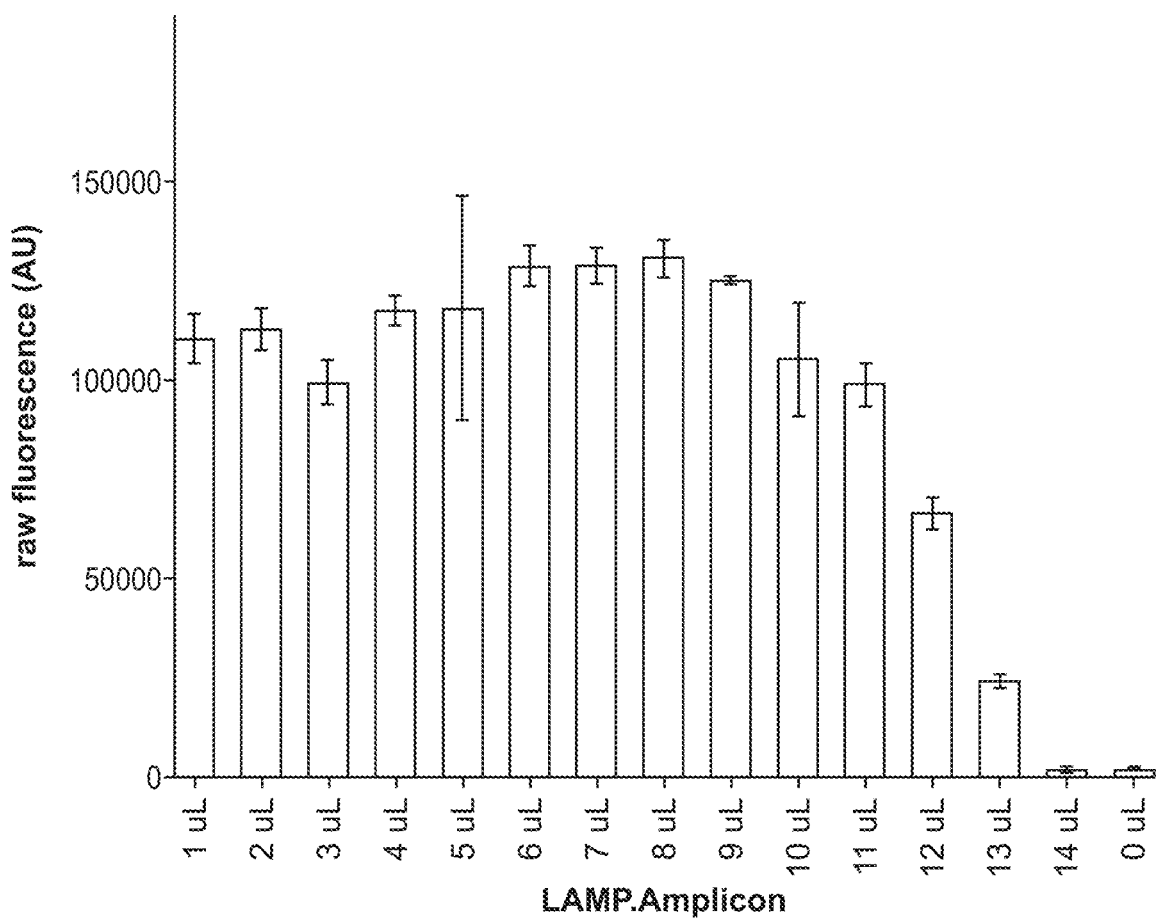

FIG. 72 shows detection of amplified HERC2 genomic DNA using a Cas12 variant (SEQ ID NO: 11) in the presence of increasing amounts of LAMP amplified DNA ("LAMP.Amplicon"). Each detection reaction was performed in the presence of 0 µL (negative control) of LAMP amplified DNA or from 1 µL to 14 µL LAMP amplified DNA per 20 µL reaction.

Figure 73:
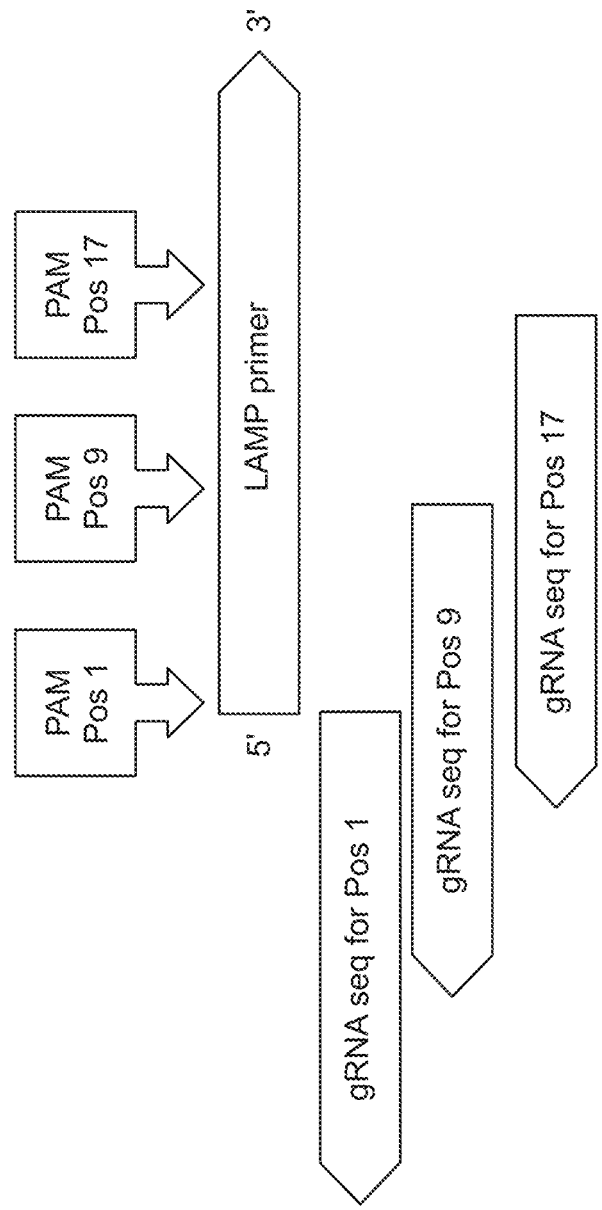

FIG. 73 shows a schematic of addition of an artificial PAM to LAMP FIP or BIP primers. PAMs were introduced at different positions within the LAMP primer, and gRNAs were designed relative to each PAM for use in CRISPR-based detection assays of target nucleic acids.

Figure 74:
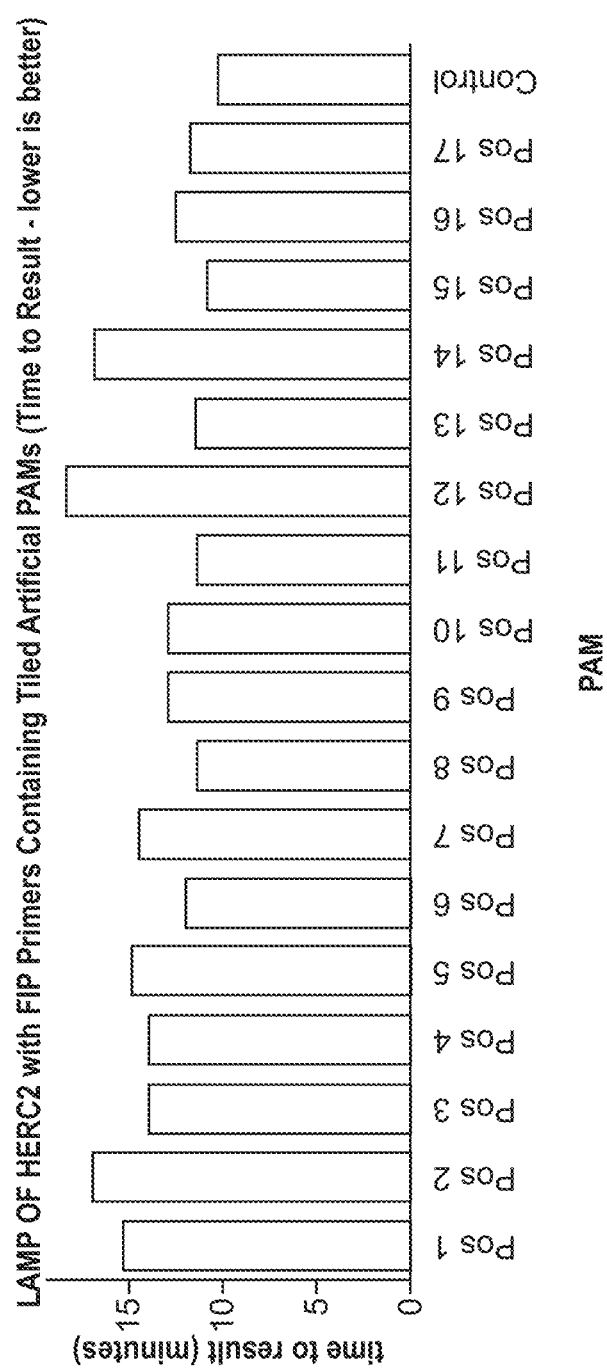

FIG. 74 shows LAMP amplification of a target human genomic DNA (HERC2, SEQ ID NO: 416) with an FIP primer having PAM sequences at varying positions to introduce an artificial PAM in the HERC2 target nucleic acid. Amplification was monitored using a SYTO9 DNA binding dye. The target was amplified using primers corresponding to SEQ ID NO: 233-SEQ ID NO: 234 and SEQ ID NO: 236-SEQ ID NO: 238 with a variable FIP depending on the position of the artificially introduced PAM. FIPs corresponding to SEQ ID NO: 265-SEQ ID NO: 281 were used to insert artificial PAMs at position 1-position 17, respectively. The FIP corresponding to SEQ ID NO: 235 was used to amplify the target without introducing a PAM.

Figure 75:
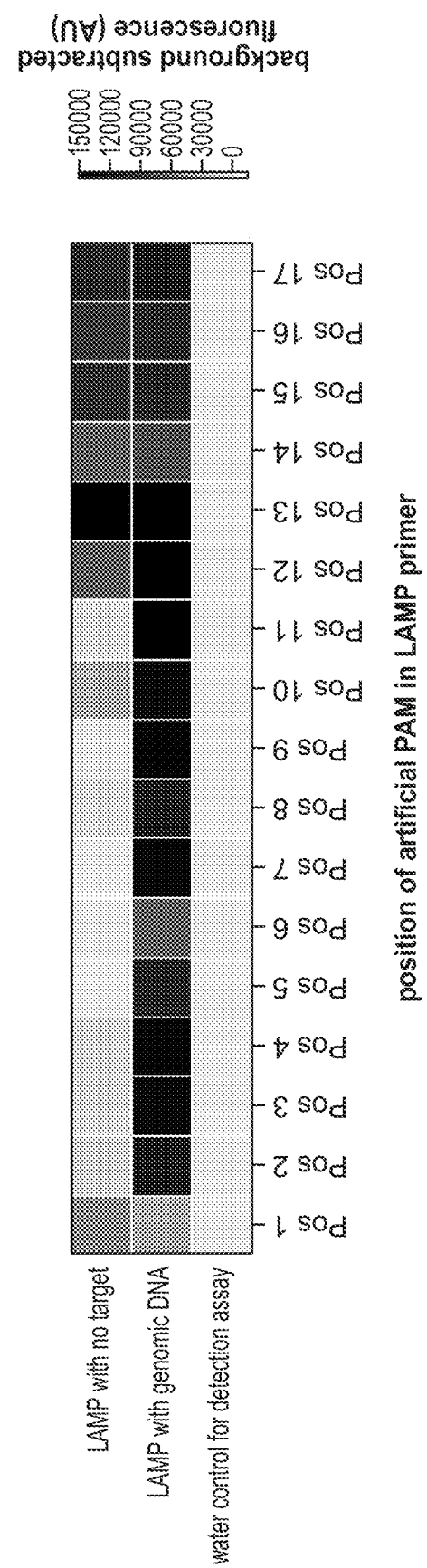

FIG. 75 shows detection of a target nucleic acid with an artificially introduced PAM using a Cas12 variant (SEQ ID NO: 11). gRNAs corresponding to SEQ ID NO: 283-SEQ ID NO: 299 were used to detect target nucleic acids with artificially introduced PAMs at position 1-position 17, respectively.

Figure 76:
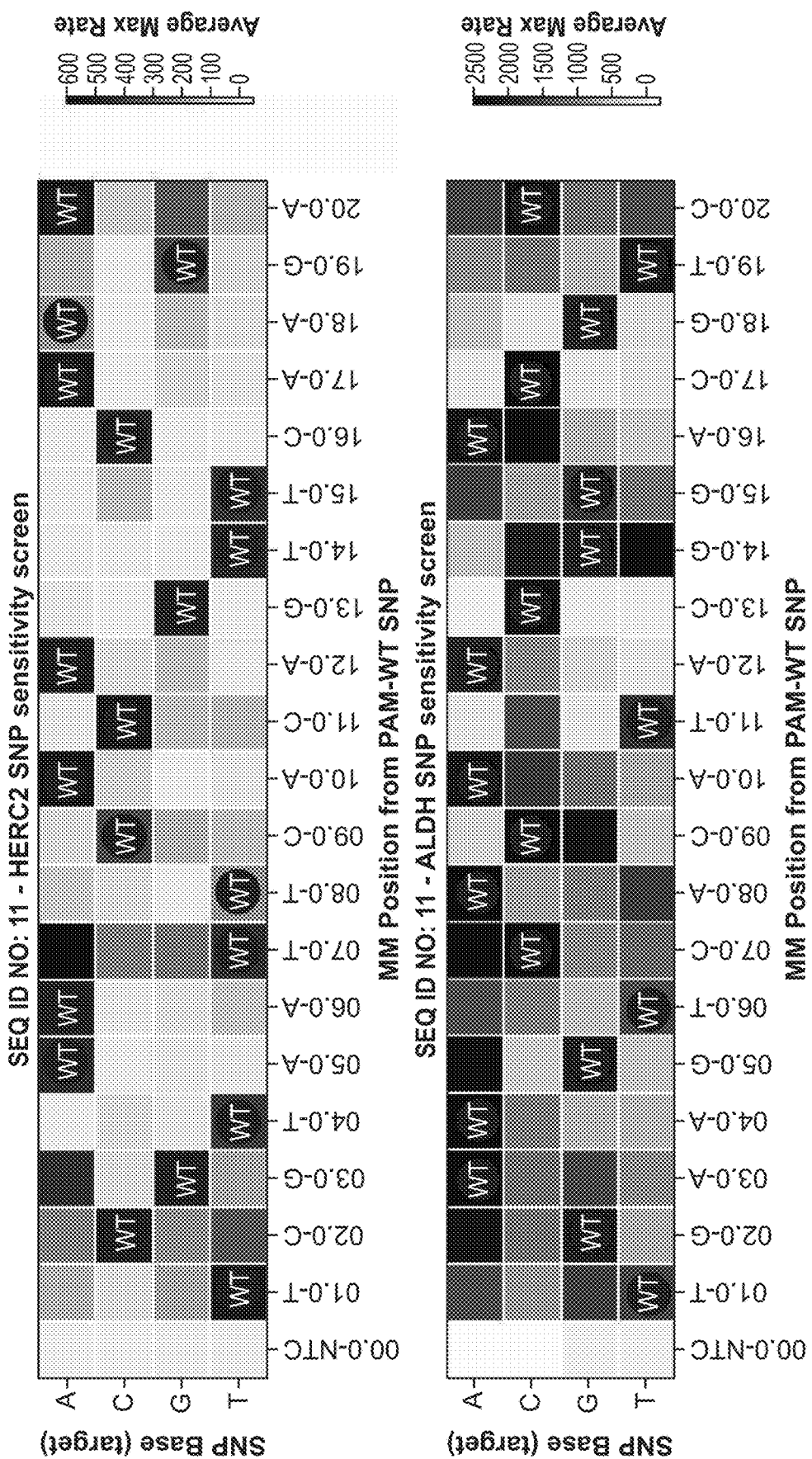

FIG. 76 shows detection of single point mutations at different positions along a nucleic acid sequence using a SEQ ID NO: 11 programmable nuclease. Point mutations corresponding to all possible nucleic acids were inserted at different positions within either a HERC2 target sequence (top, wild type sequence corresponding to SEQ ID NO: 416) or an ALDH2 target sequence (bottom, wild type sequence corresponding to SEQ ID NO: 417). The HERC2 sequence was detected using a gRNA corresponding to SEQ ID NO: 246 (top plot) and the ALDH sequence was detected using a gRNA corresponding to SEQ ID NO: 425 (bottom plot).

Figure 77:
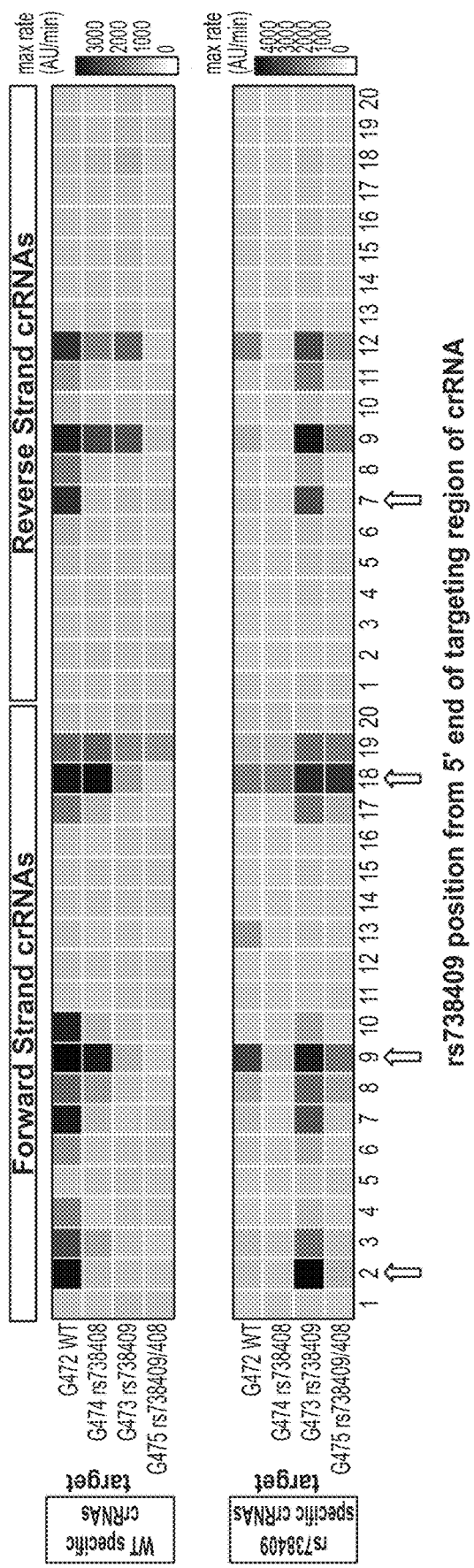

FIG. 77 shows detection of two PNPLA3 SNPs in a target nucleic acid sequence without a native PAM using a SEQ ID NO: 11 programmable nuclease. Guide RNAs corresponding to SEQ ID NO: 300-SEQ ID NO: 319 were directed to the wild type (SEQ ID NO: 415, "WT") sequence on the forward strand at position 1-position 20, respectively. gRNAs corresponding to SEQ ID NO: 320-SEQ ID NO: 339 were directed to the wild type ("WT") sequence on the reverse strand at position 1-position 20, respectively. gRNAs corresponding to SEQ ID NO: 340-SEQ ID NO: 359 were directed to the mutant (SEQ ID NO: 414, "rs738409") sequence on the forward strand at position 1-position 20, respectively. gRNAs corresponding to SEQ ID NO: 360-SEQ ID NO: 379 were directed to the mutant ("rs738409") sequence on the reverse strand at position 1-position 20, respectively. Each gRNA was used to detect four different target sequences corresponding to the wild type sequence (SEQ ID NO: 415, "WT"), a sequence with a point mutation at a first site (SEQ ID NO: 413, "rs738408"), a sequence with a point mutation at a second site (SEQ ID NO: 414, "rs738409"), or a sequence with point mutations at both the first site and the second site (SEQ ID NO: 412, "rs738409+rs738408").

Figure 78:
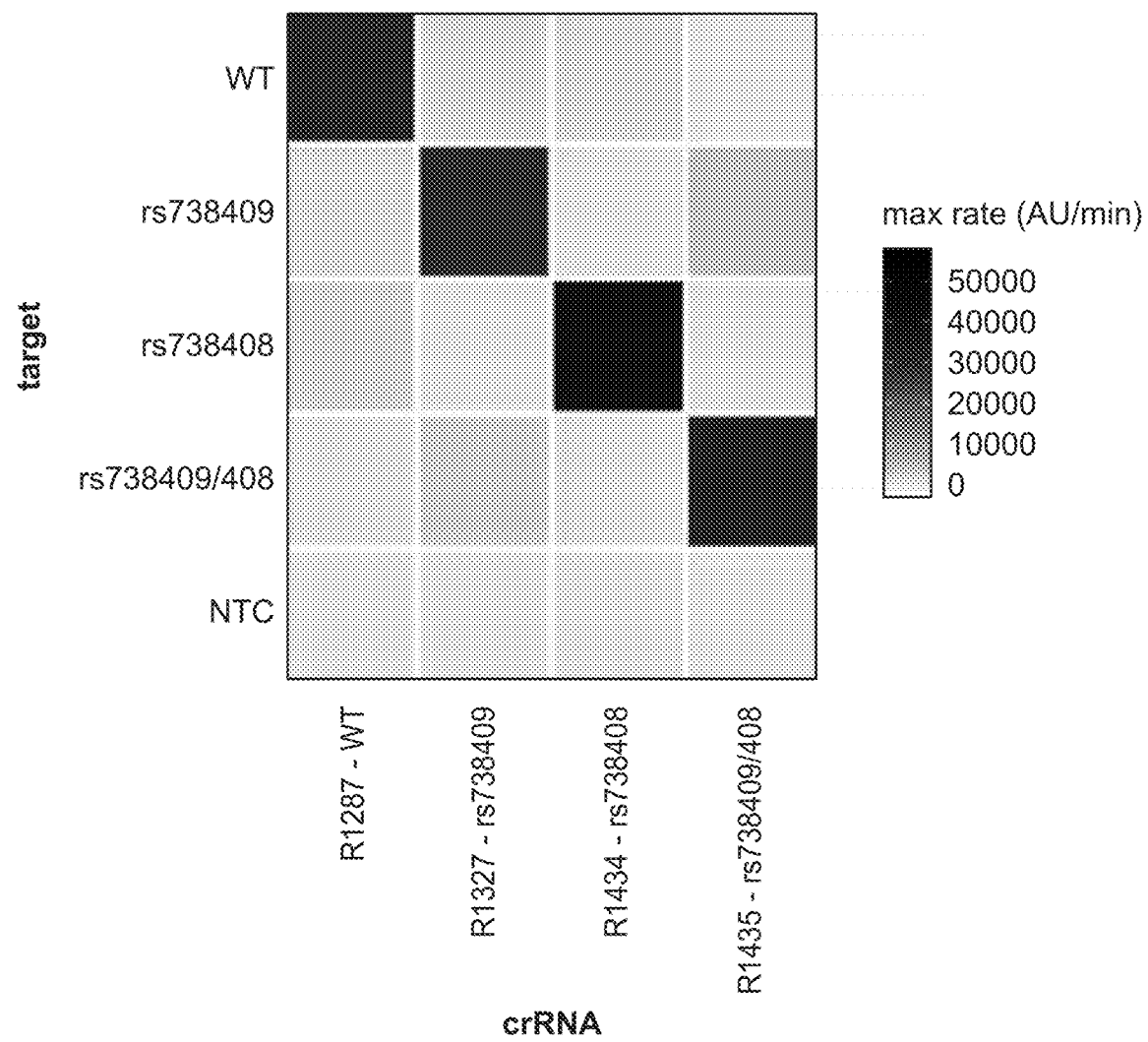

FIG. 78 shows detection of single and double mutations in a target nucleic acid sequence using a SEQ ID NO: 11 programmable nuclease. Target sequences corresponding to SEQ ID NO: 412-SEQ ID NO: 415 were detected.

Figure 79:
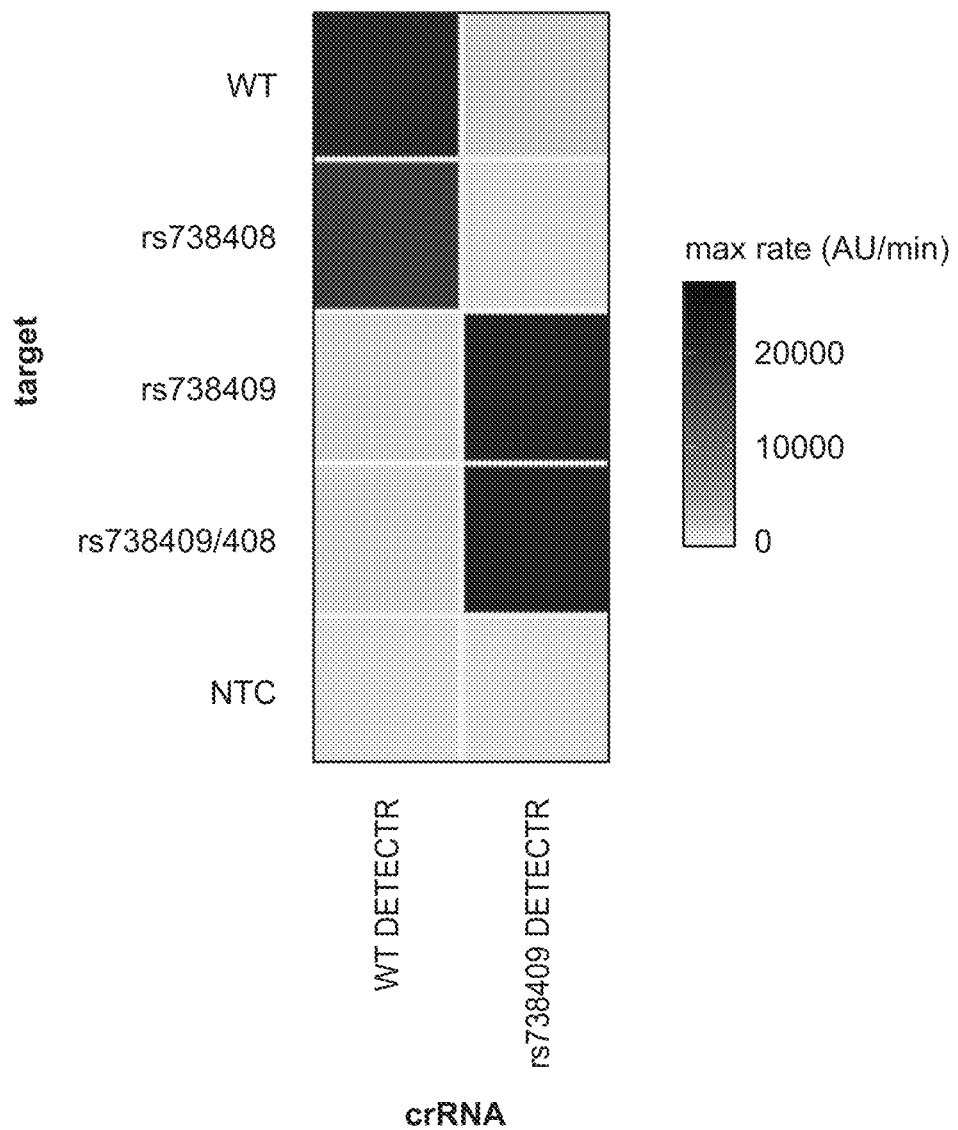

FIG. 79 shows detection of two PNPLA3 SNPs in a target nucleic acid sequence without a native PAM using a SEQ ID NO: 11 programmable nuclease. Target sequences corresponding to SEQ ID NO: 412-SEQ ID NO: 415 were detected. A sample without a target sequence (non-target control, "NTC") was used as a negative control. Sequences were detected using pooled gRNAs directed to either the wild type sequence (SEQ ID NO: 301 and SEQ ID NO: 421, "WT DETECTR") or the sequence containing a mutation at the second position (SEQ ID NO: 341 and SEQ ID NO: 422, "rs738409 DETECTR").

Figure 80:
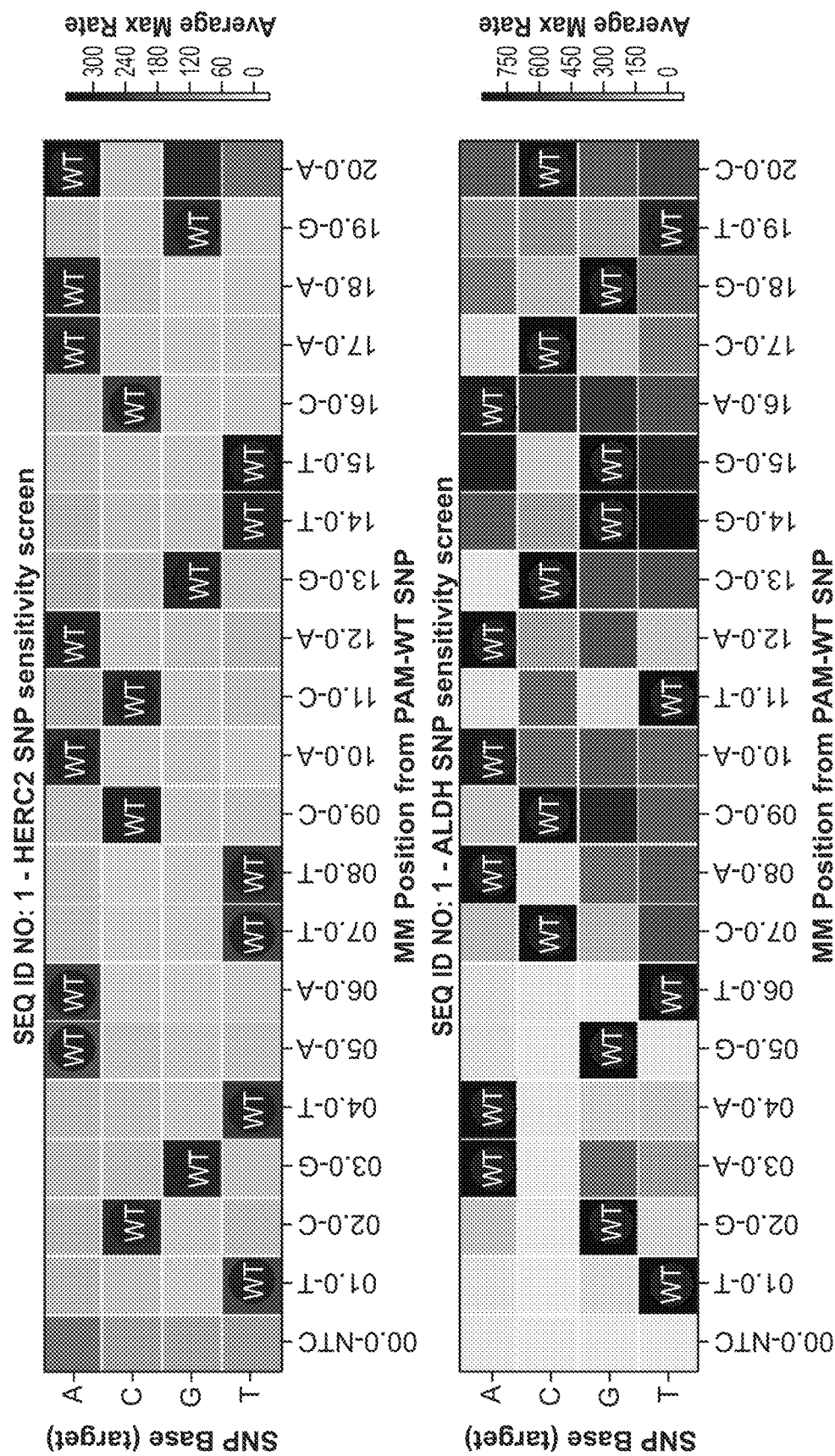

FIG. 80 shows detection of single point mutations at different positions along a nucleic acid sequence using LbCas12a (SEQ ID NO: 1). Point mutations corresponding to all possible nucleic acids were inserted at different positions within either a HERC2 target sequence (top, wild type sequence corresponding to SEQ ID NO: 416) or an ALDH2 target sequence (bottom, wild type sequence corresponding to SEQ ID NO: 417). The HERC2 sequence was detected using a gRNA corresponding to SEQ ID NO: 246 (top plot) and the ALDH sequence was detected using a gRNA corresponding to SEQ ID NO: 425 (bottom plot).

Figure 81:
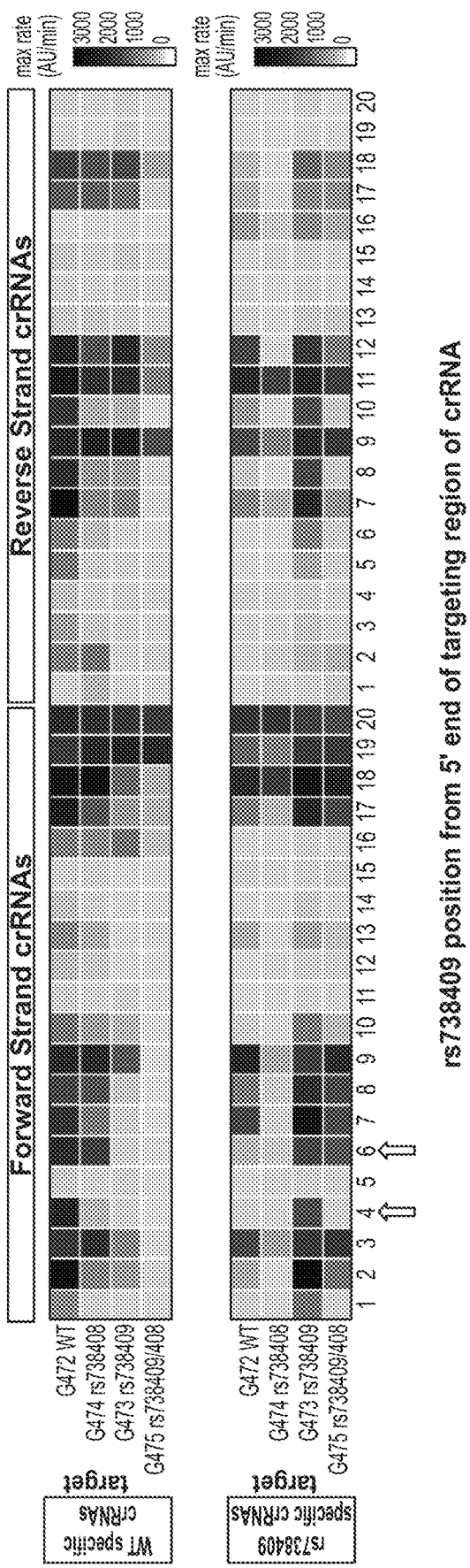

FIG. 81 shows detection of two PNPLA3 SNPs in a target nucleic acid sequence without a native PAM using LbCas12a (SEQ ID NO: 1). Guide RNAs corresponding to SEQ ID NO: 300-SEQ ID NO: 319 were directed to the wild type (SEQ ID NO: 415, "WT") sequence on the forward strand at position 1-position 20, respectively. gRNAs corresponding to SEQ ID NO: 320-SEQ ID NO: 339 were directed to the wild type ("WT") sequence on the reverse strand at position 1-position 20, respectively. gRNAs corresponding to SEQ ID NO: 340-SEQ ID NO: 359 were directed to the mutant (SEQ ID NO: 414, "rs738409") sequence on the forward strand at position 1-position 20, respectively. gRNAs corresponding to SEQ ID NO: 360-SEQ ID NO: 379 were directed to the mutant ("rs738409") sequence on the reverse strand at position 1-position 20, respectively. Each gRNA was used to detect four different target sequences corresponding to the wild type sequence (SEQ ID NO: 415, "WT"), a sequence with a point mutation at a first site (SEQ ID NO: 413, "rs738408"), a sequence with a point mutation at a second site (SEQ ID NO: 414, "rs738409"), or a sequence with point mutations at both the first site and the second site (SEQ ID NO: 412, "rs738409+rs738408").

Figure 82:
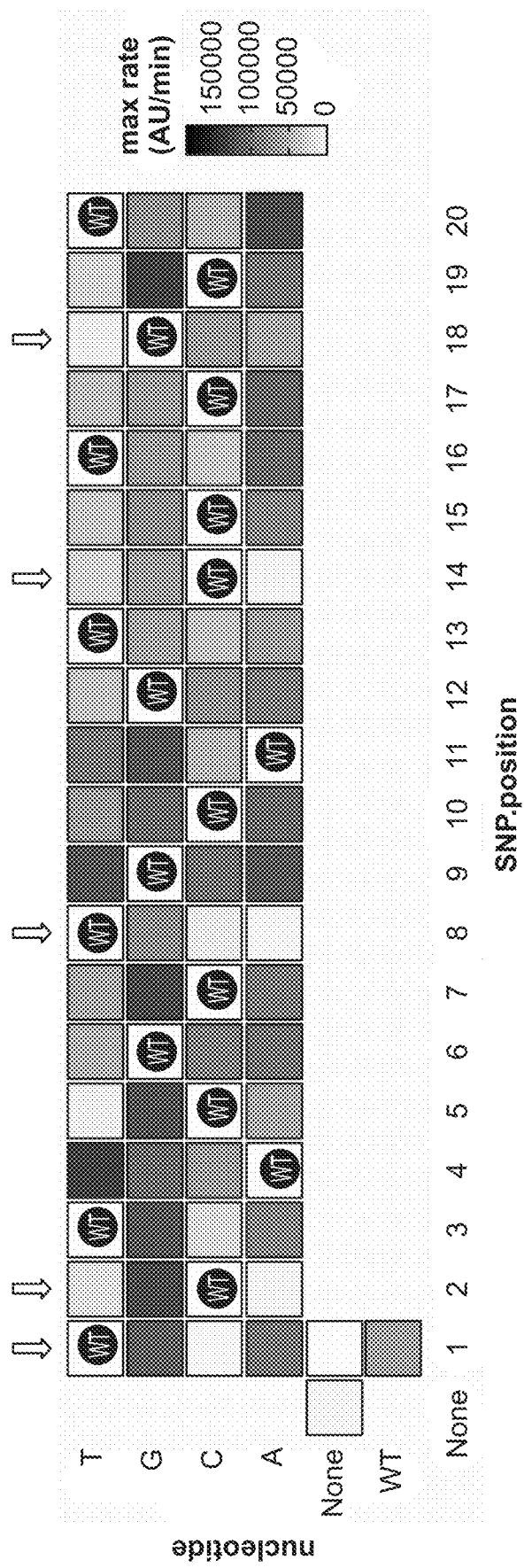

FIG. 82 shows detection of single point mutations at different positions along target RNA sequence (SEQ ID NO: 748, UGGACAAAGCGUCUACGCUGCAGUCCUCG-CUCACUGGGCA) using LbuCas13a (SEQ ID NO: 104). Data is not shown for wild type positions (black circles labeled with "WT"). Detection of the wild type sequence is shown in the square marked "WT" at SNP position 1. Detection of a negative control (water) is shown in the square marked "None" at position "None." The targets were detected using a gRNA corresponding to SEQ ID NO: 507 (GGCCACCCCAAAAAUGAAGGGGAC-UAAAACAAGCGAGGACUGCAGCGUAGA).

Figure 83:
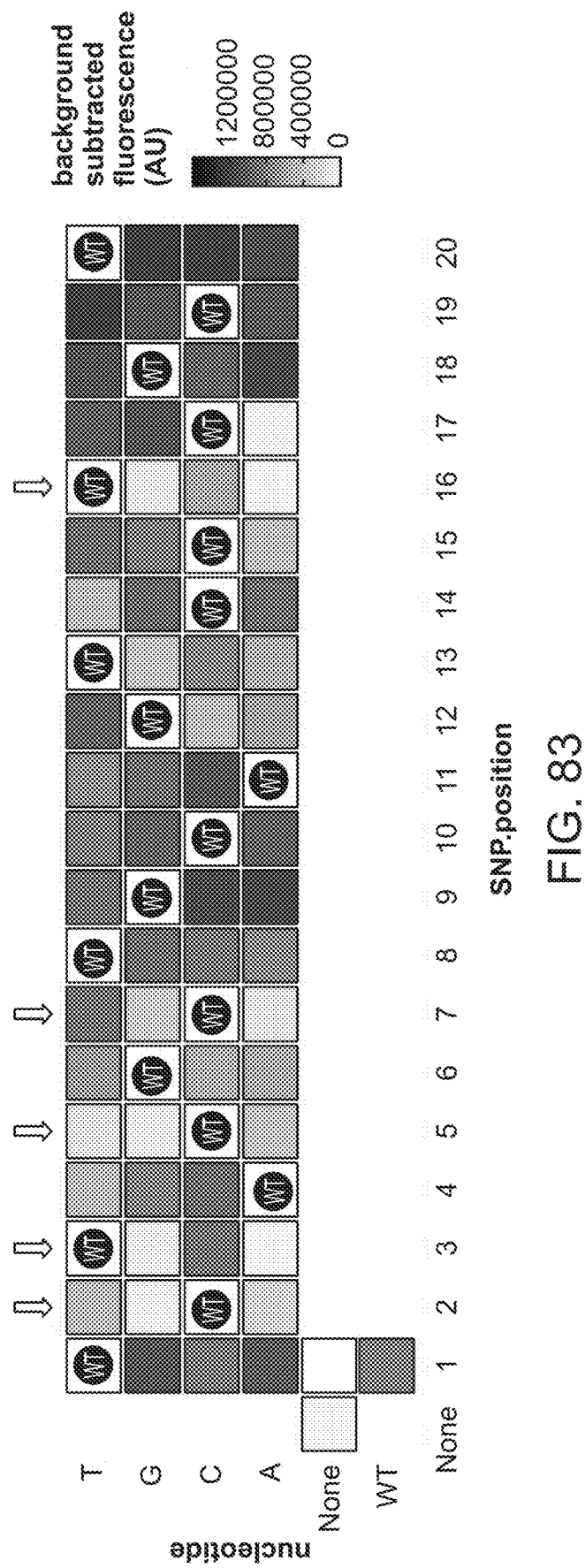

FIG. 83 shows detection of single point mutations at different positions along target ssDNA (SEQ ID NO: 749, TTTTGGACAAAGCGTCTACGCTGCAGTCCTCGCT-CACTGGGCACGGTG) sequence using LbuCas13a (SEQ ID NO: 104). Data is not shown for wild type positions (black circles labeled with "WT"). Detection of the wild type sequence is shown in the square marked "WT" at SNP position 1. Detection of a negative control (water) is shown in the square marked "None" at position "None." The targets were detected using a gRNA corresponding to SEQ ID NO: 507.

Figure 84:
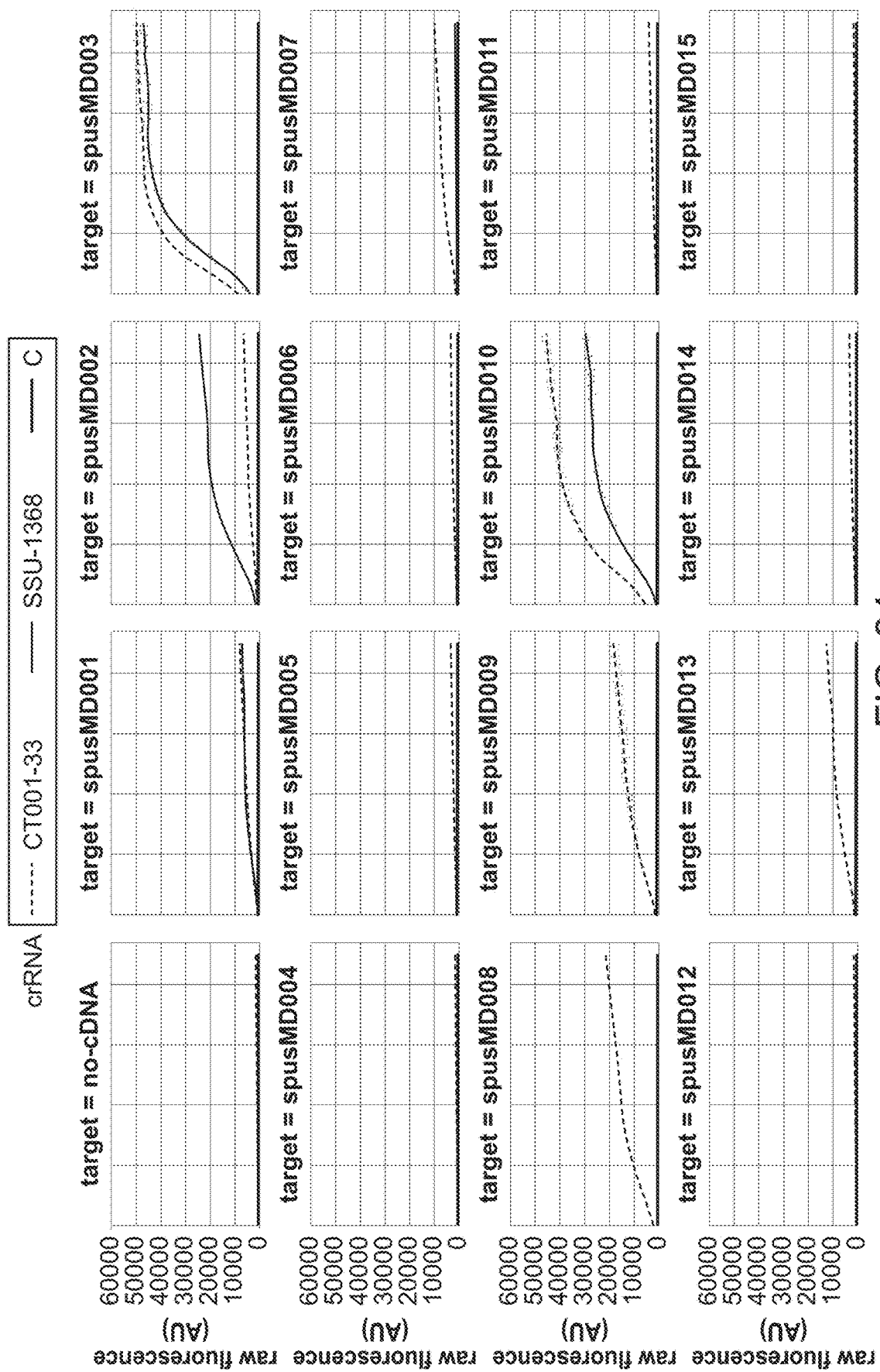
Figure 84:
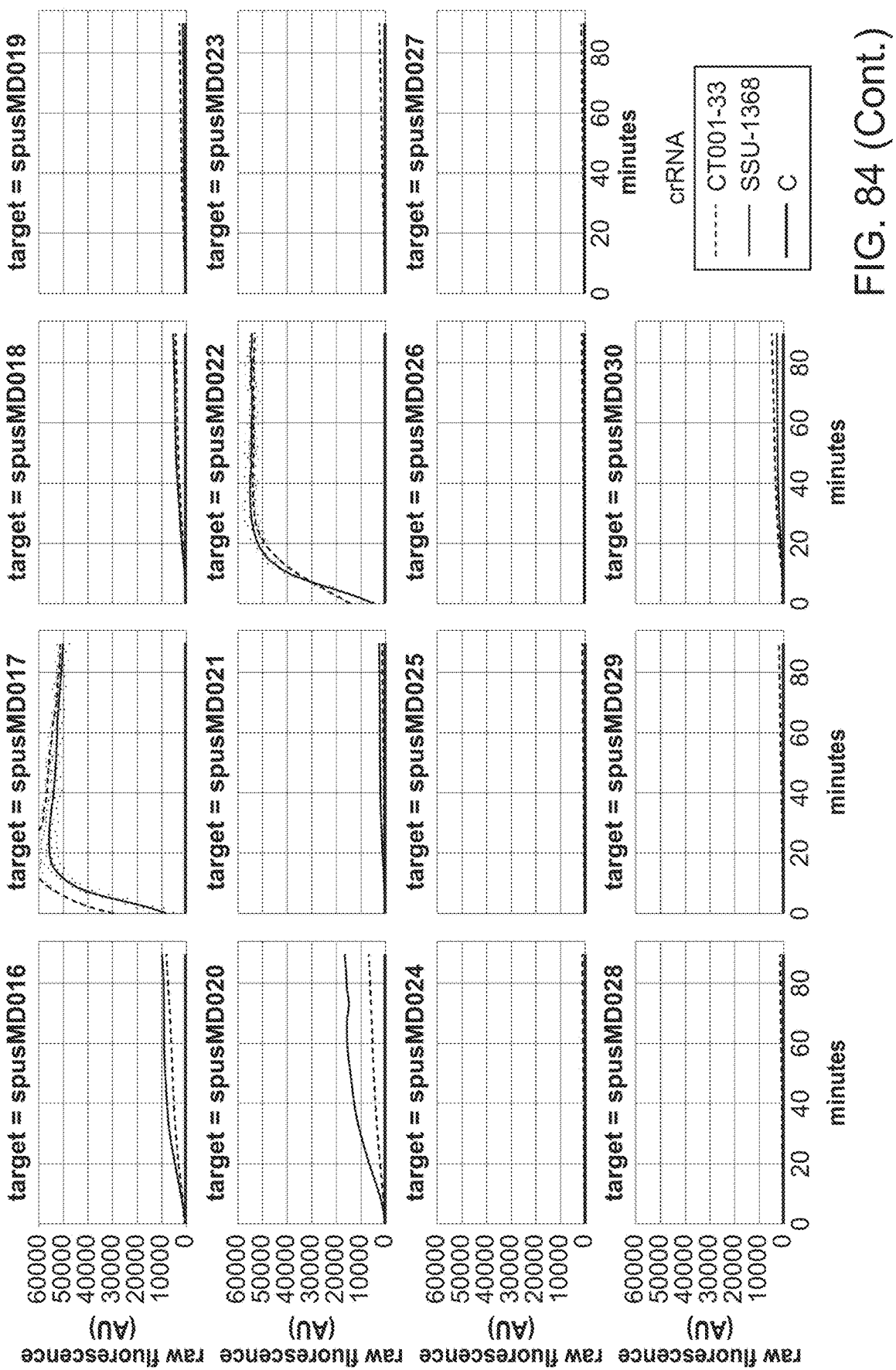

FIG. 84 shows detection of a *Chlamydia trachomatis* target nucleic acid sequence with LbuCas13a (SEQ ID NO: 104) following polymerase chain reaction (PCR) amplification and in vitro transcription (IVT) of samples that were either positive or negative for *Chlamydia*. Targets were detected with either a gRNA targeted to *Chlamydia* 5S rRNA (SEQ ID NO: 418), a gRNA targeted to *Chlamydia* 16S rRNA (SEQ ID NO: 419), or an off-target gRNA (SEQ ID NO: 420).

Figure 85:
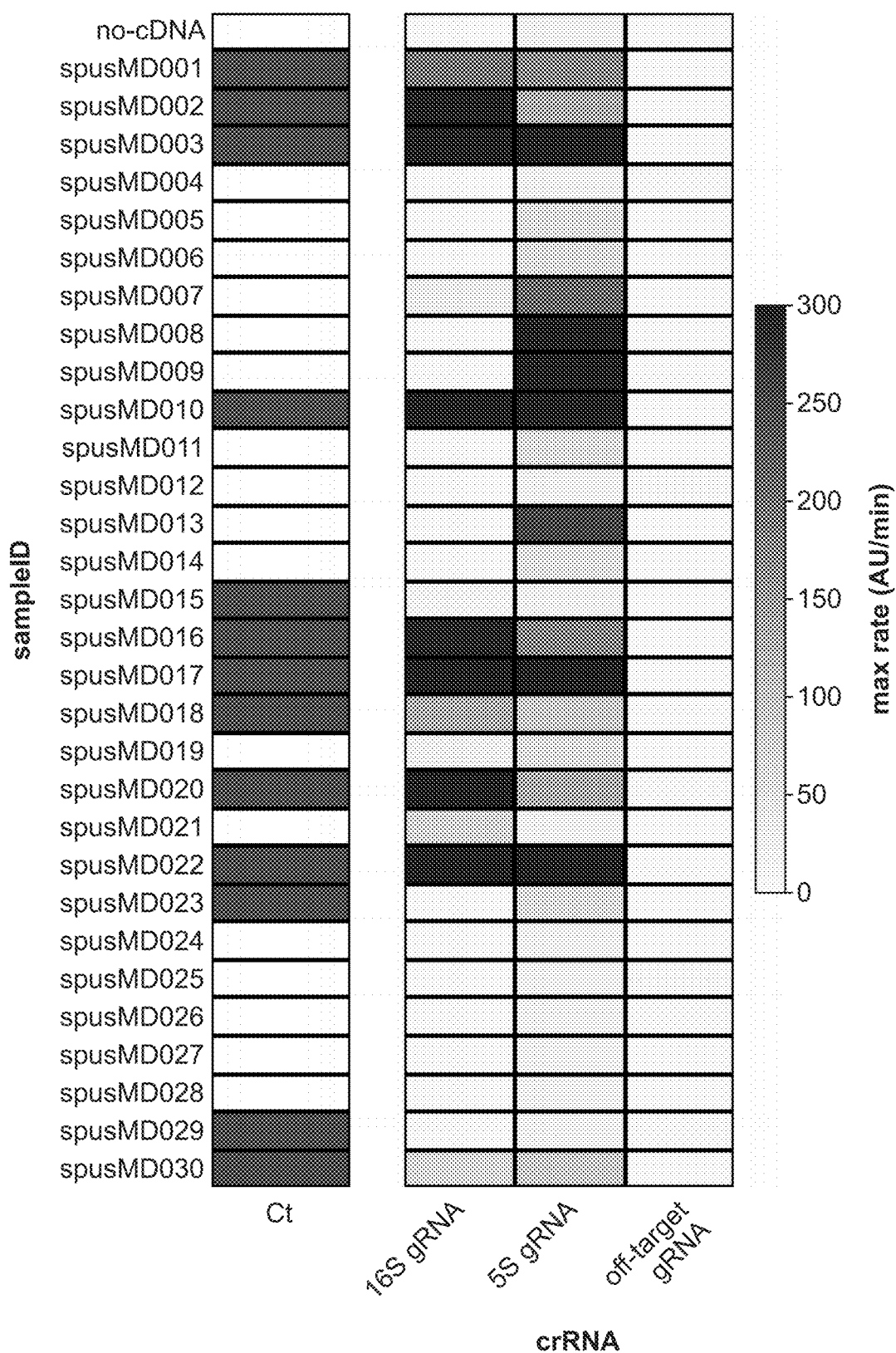

FIG. 85 shows heatmaps of the fluorescence detected in FIG. 84 (right). Panels on the right indicate the maximum fluorescent rate detected with either a gRNA targeting a *Chlamydia* 16S RNA sequence (SEQ ID NO: 419, "16S gRNA"), a gRNA targeting a *Chlamydia* 5S RNA sequence (SEQ ID NO: 418, "5S gRNA"), or a gRNA not directed to a *Chlamydia* target sequence (SEQ ID NO: 420, "off-target gRNA"). Shaded boxes in the left column ("Ct") indicate that the sample was positive for *Chlamydia*.

Figure 86:
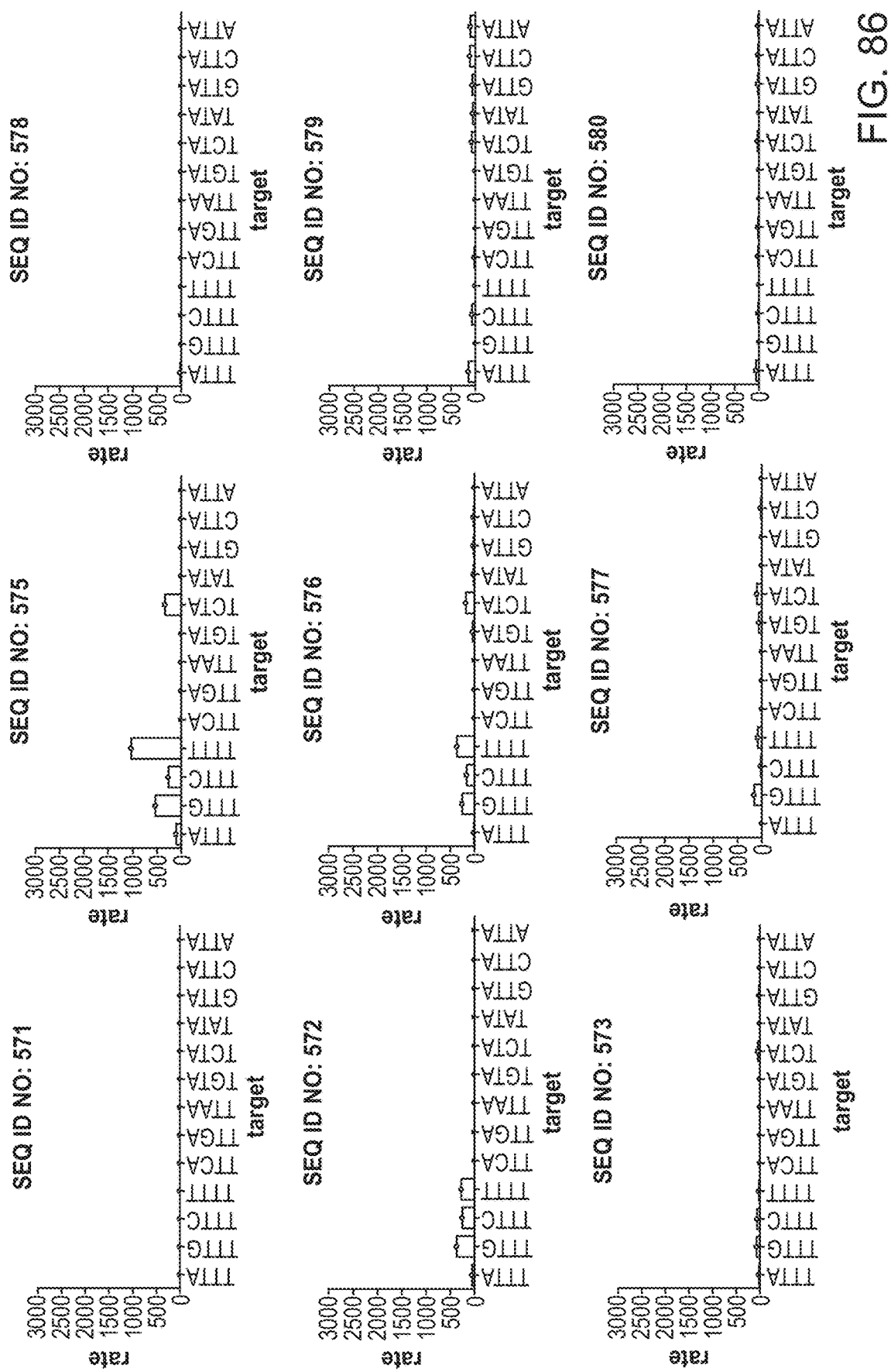

FIG. 86 shows trans cleavage rates of different Cas12 variants upon complex formation with a gRNA and a target sequence comprising different PAM sequences. Individual plots show trans cleavage rates for each Cas12 variant, and each plot illustrates the cleavage rate for target sequences comprising different PAM sequences. PAM sequences and the sequences of the target and non-target strands are provided in TABLE 29. Figure discloses "TTTT", "TTTG", "TTTC", "TTTA", "TTGA", "TTCA", "TTAA", "TGTA", "TCTA", "TATA", "GTTA", "CTTA", and "ATTA" as SEQ ID NOS 381-393 respectively.

Figure 87A:
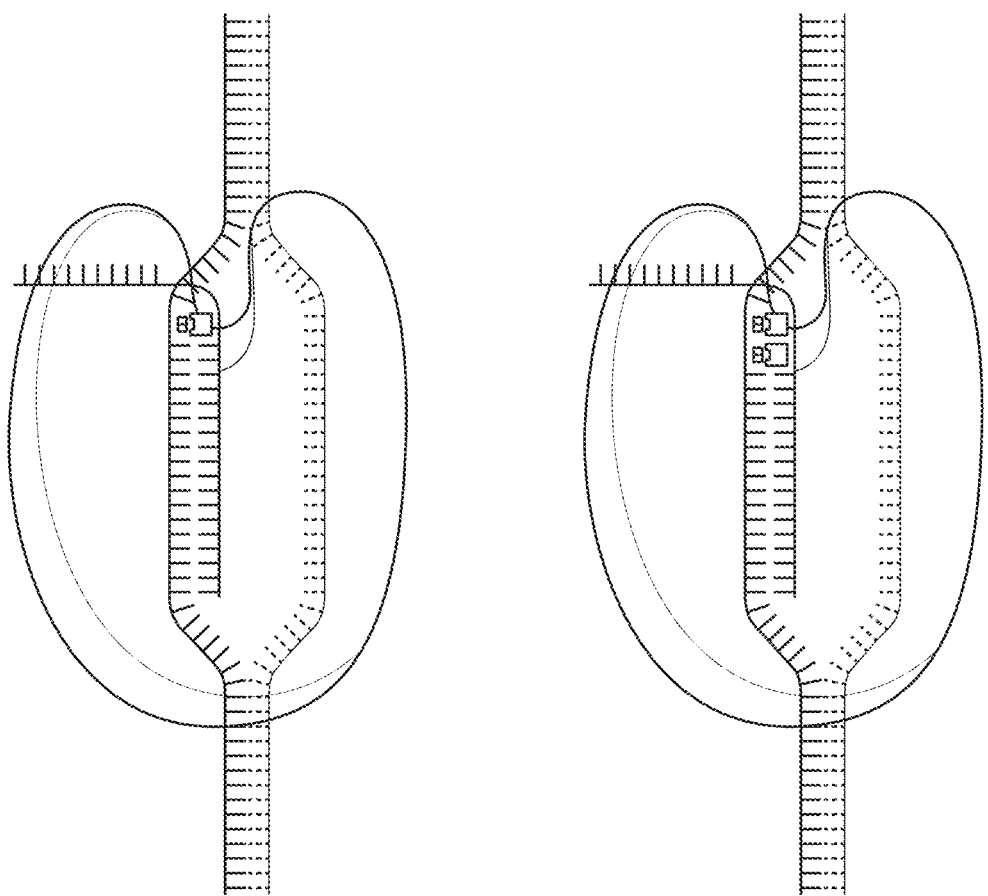

FIG. 87A shows a schematic of a Cas protein, gRNA, and target sequence complex comprising either a single base pair mismatch (top) or a double base pair mismatch (bottom) between the gRNA and the target sequence.

Figure 87B:
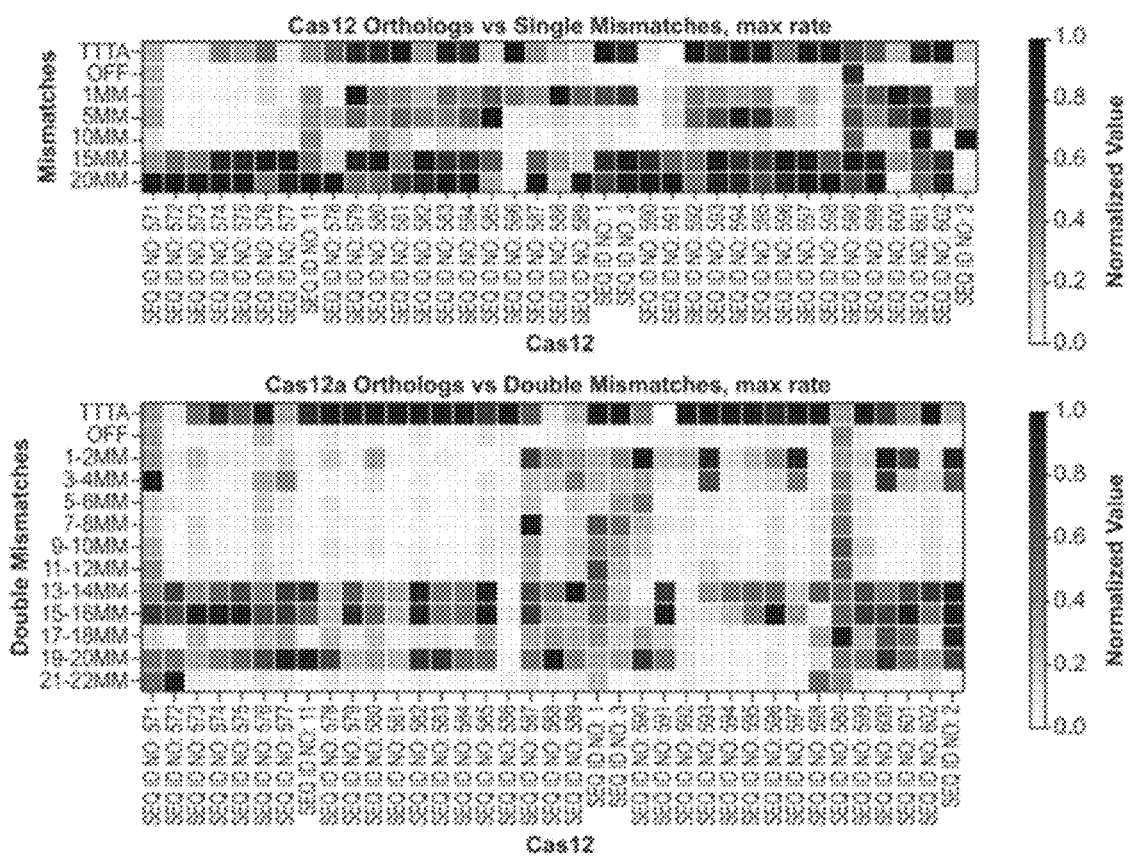

FIG. 87B shows trans cleavage activity of different Cas12 programmable nuclease variants of SEQ ID NO: 571-SEQ ID NO: 577, SEQ ID NO: 11, SEQ ID NO: 578-SEQ ID NO: 589, SEQ ID NO: 1, SEQ ID NO: 3, SEQ ID NO: 590-SEQ ID NO: 598, SEQ ID NO: 580, and SEQ ID NO: 599-SEQ ID NO: 602, and SEQ ID NO: 2 upon complex formation with a gRNA and a target sequence having either a single base pair mismatch (top) or a double base pair mismatch (bottom). Trans cleavage activity was tested for mismatches at different positions relative to the PAM sequence. Single or double mismatches were introduced in the first ("1 MM"), fifth ("5 MM"), tenth ("10 MM"), fifteenth ("15 MM"), and twentieth ("20 MM") nucleotide position after the PAM (TTTA (SEQ ID NO: 384)). PAM sequences and the sequences of the target and non-target strands are provided in TABLE 29.

Figure 88:
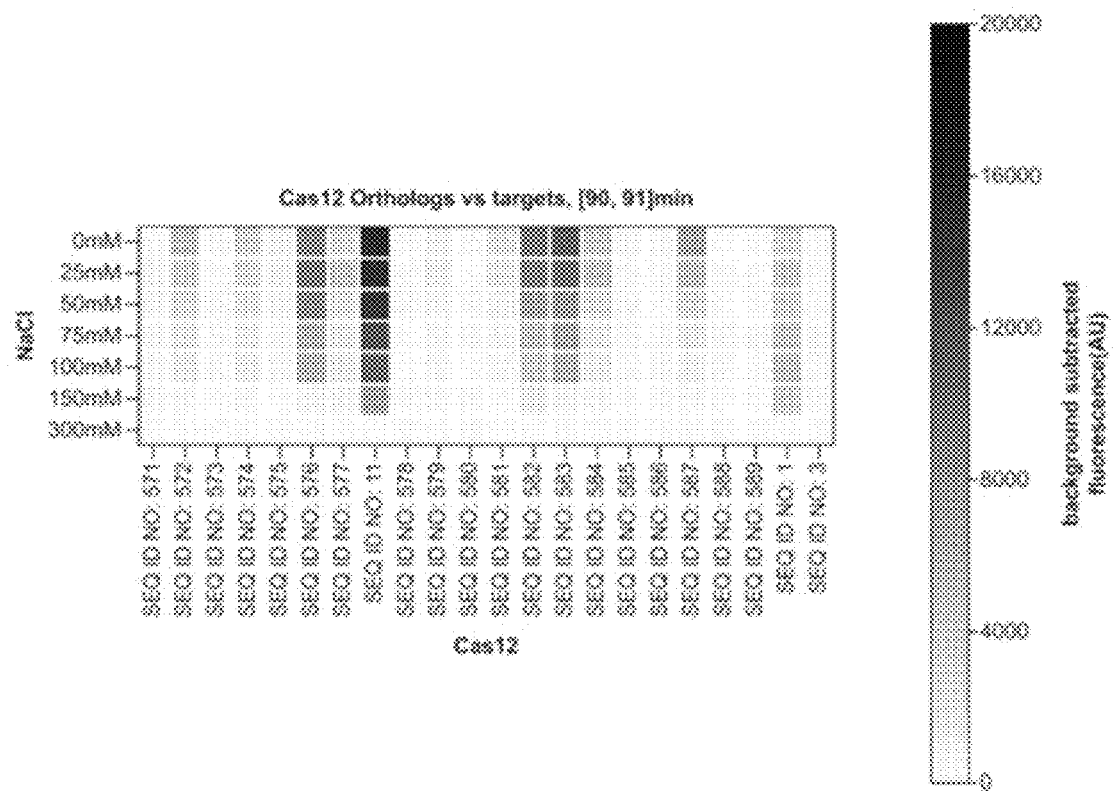

FIG. 88 shows trans cleavage activity of different Cas12 variants of SEQ ID NO: 571-SEQ ID NO: 577, SEQ ID NO: 11, SEQ ID NO: 578-SEQ ID NO: 589, SEQ ID NO: 1, and SEQ ID NO: 3 at different concentrations of NaCl.

Figure 89:
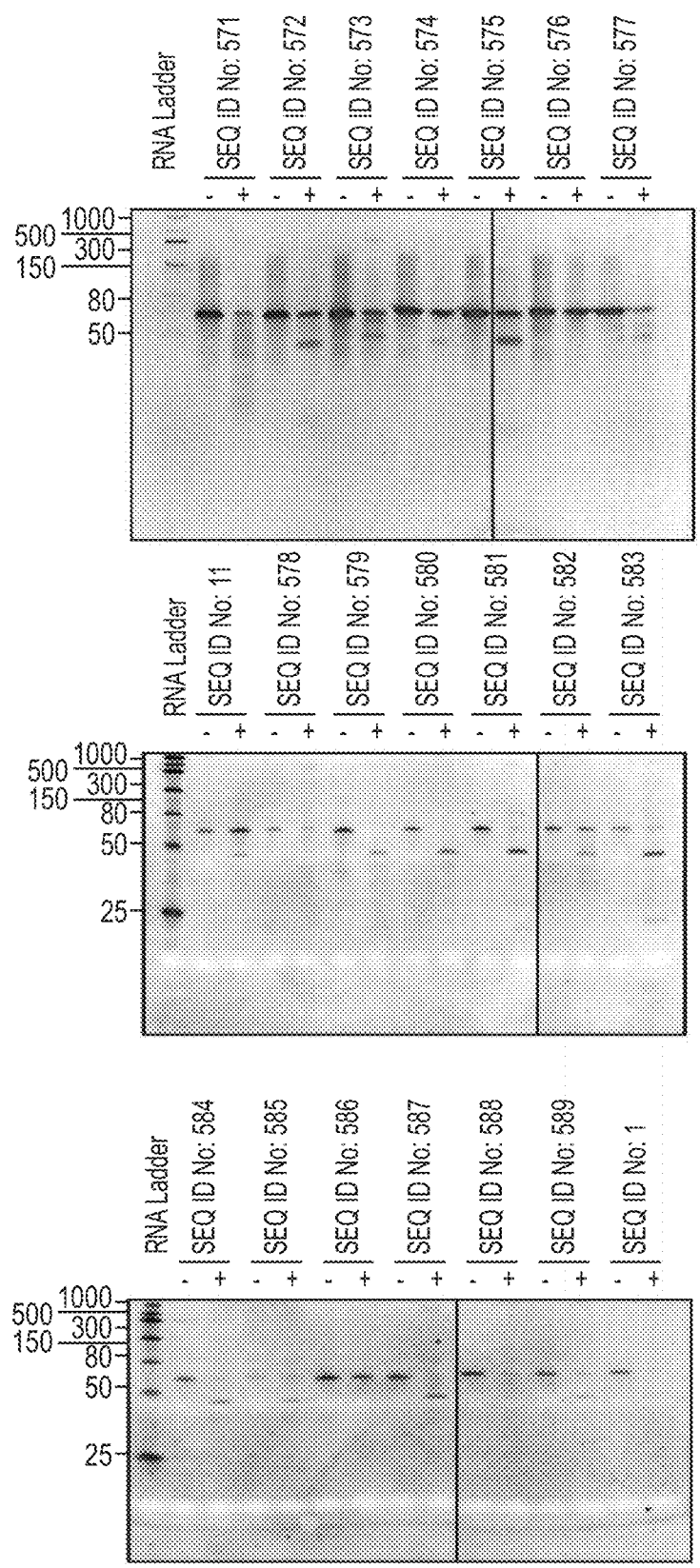
Figure 89:
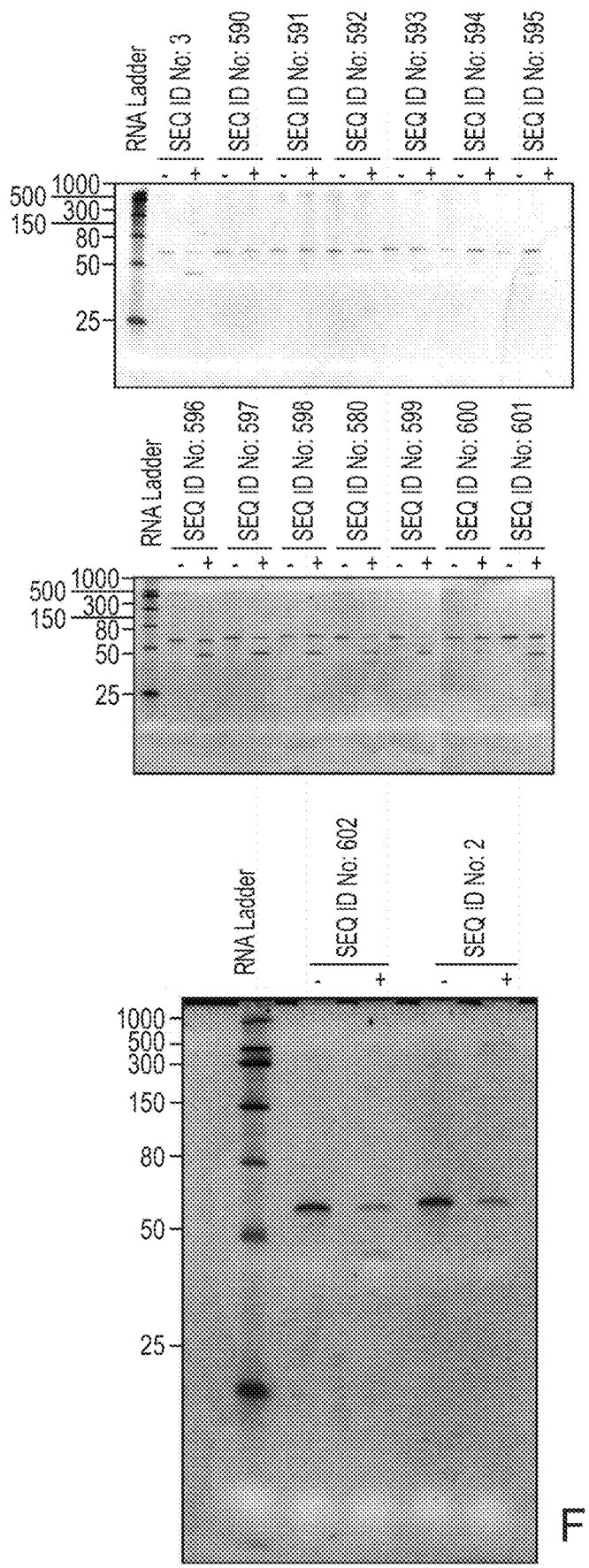

FIG. 89 shows urea PAGE gels of pre-crRNA processing activity of different Cas12 variants of SEQ ID NO: 571-SEQ ID NO: 577, SEQ ID NO: 11, SEQ ID NO: 578-SEQ ID NO: 589, SEQ ID NO: 1, SEQ ID NO: 3, SEQ ID NO: 590-SEQ ID NO: 598, SEQ ID NO: 580, SEQ ID NO: 599-SEQ ID NO: 602, and SEQ ID NO: 2 in the presence ("+") or absence ("−") of a Cas protein. Bands shown are RNA bands.

Figure 90:
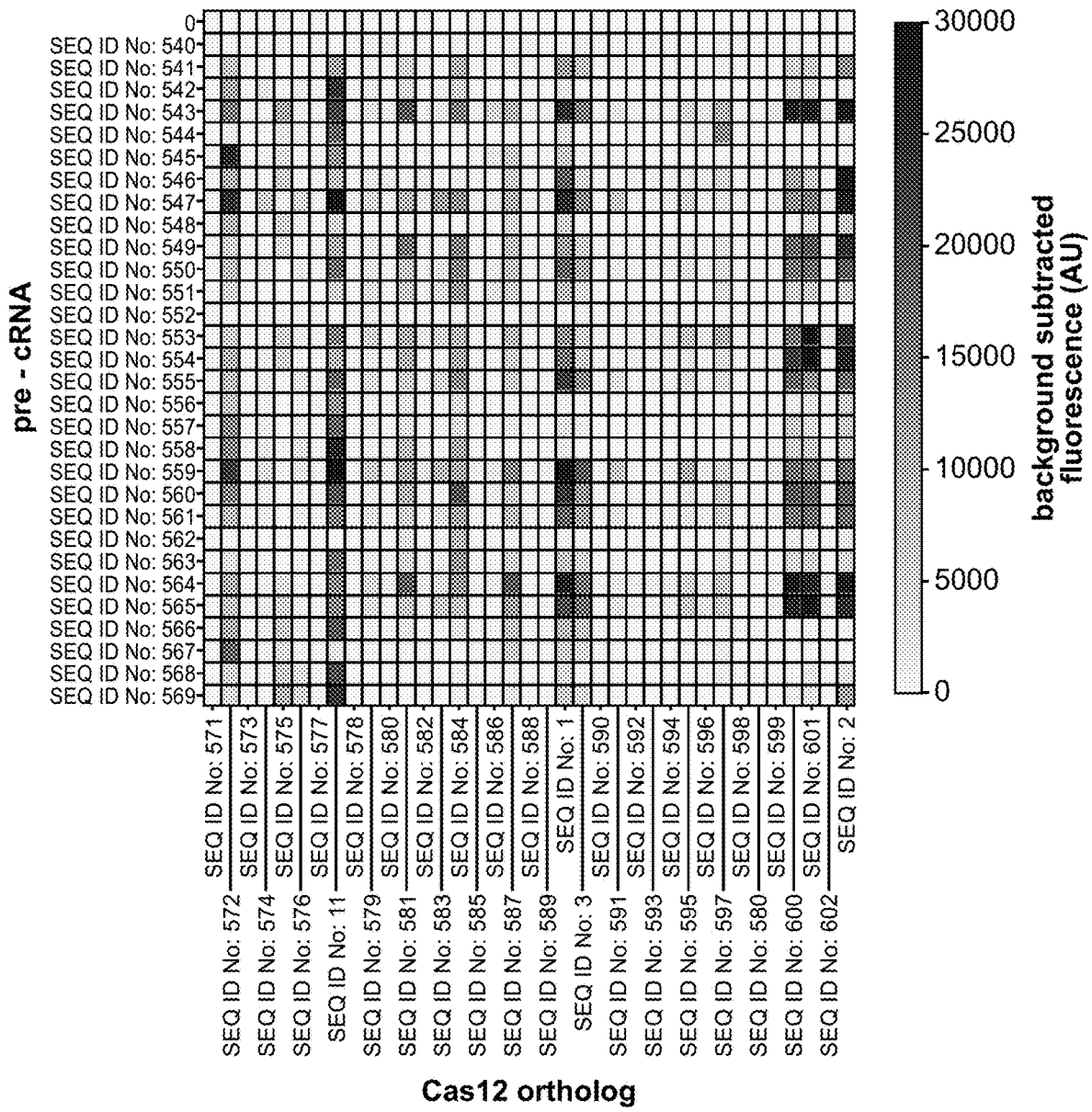

FIG. 90 shows trans cleavage activity of different Cas12 variants of SEQ ID NO: 571-SEQ ID NO: 577, SEQ ID NO: 11, SEQ ID NO: 578-SEQ ID NO: 589, SEQ ID NO: 1, SEQ ID NO: 3, SEQ ID NO: 649-SEQ ID NO: 598, SEQ ID NO: 580, SEQ ID NO: 599-SEQ ID NO: 602, and SEQ ID NO: 2 in the presence of different crRNAs based on the native crRNAs found in the CRISPR locus for native Cas12 proteins. Pre-crRNA sequences are provided in TABLE 30. The target sequences is set forth in SEQ ID NO: 670.

Figure 91:
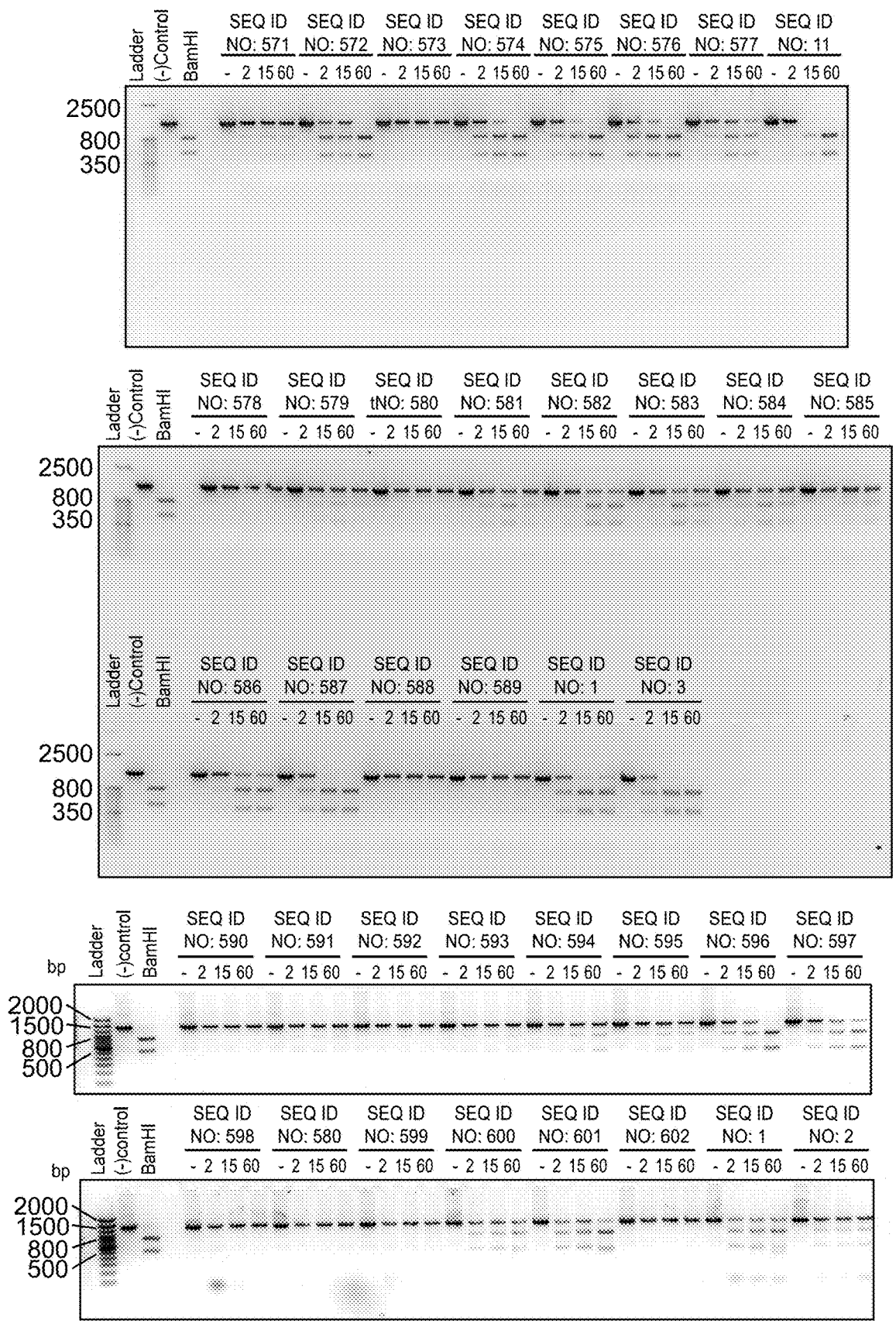

FIG. 91 shows cis cleavage activity of different Cas12 variants of SEQ ID NO: 571-SEQ ID NO: 577, SEQ ID NO: 11, SEQ ID NO: 578-SEQ ID NO: 589, SEQ ID NO: 1, SEQ ID NO: 3, SEQ ID NO: 590-SEQ ID NO: 598, SEQ ID NO: 580, SEQ ID NO: 599-SEQ ID NO: 602, and SEQ ID NO: 2 after incubation with a target nucleic acid sequence for 10 minutes. Cleavage with BamHI is shown as a cleavage positive control.

Figure 92:
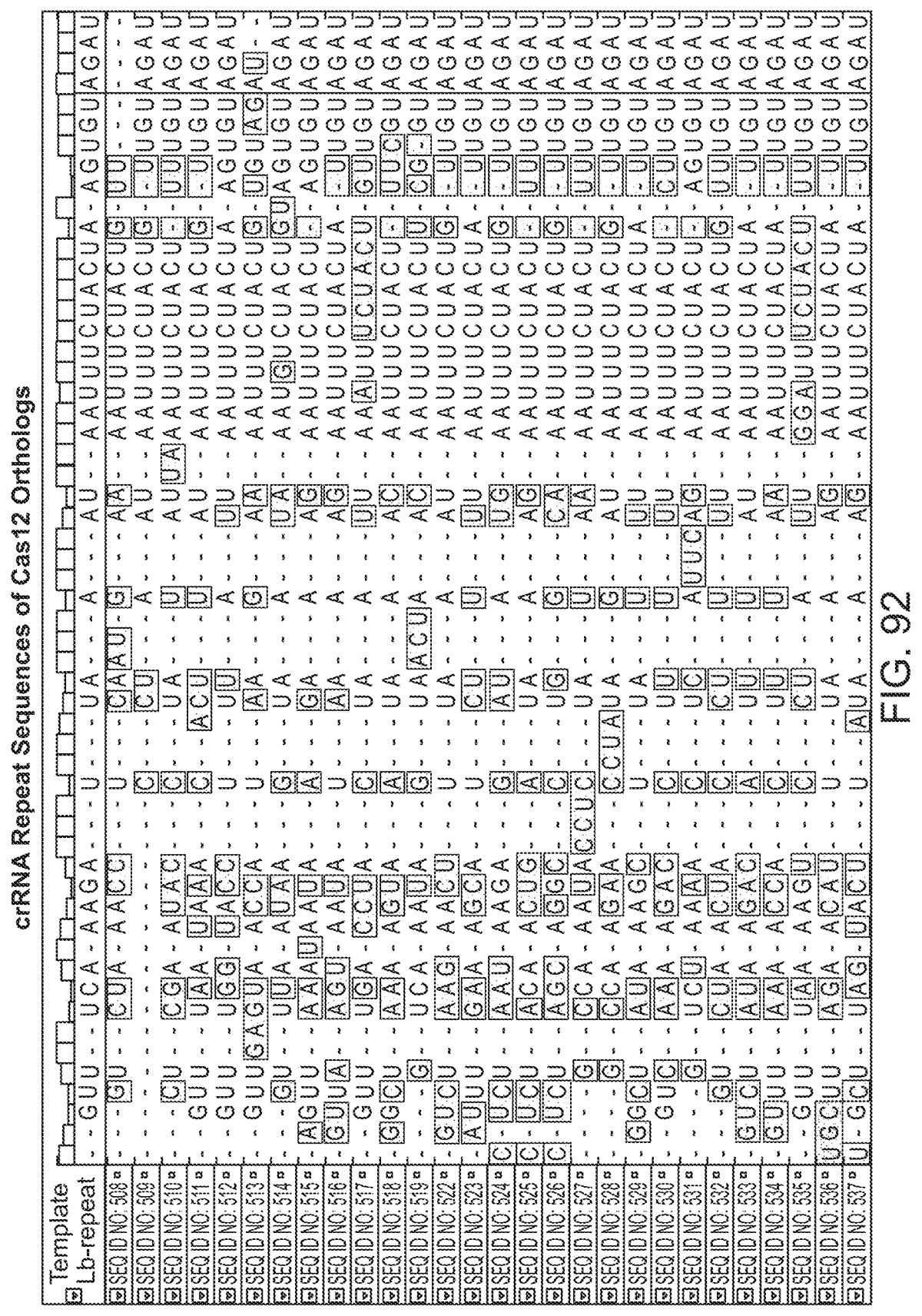

FIG. 92 shows sequence alignments of the repeat region of different Cas12 variants aligned to the repeat sequence of LbCas12a (SEQ ID NO: 1). Repeat sequences of the Cas12 variants correspond to SEQ ID NO: 508-SEQ ID NO: 520 and SEQ ID NO: 522-SEQ ID NO: 536. The repeat sequence of LbCas12a corresponds to SEQ ID NO: 521. Repeat sequences are provided in TABLE 30.

Figure 93:
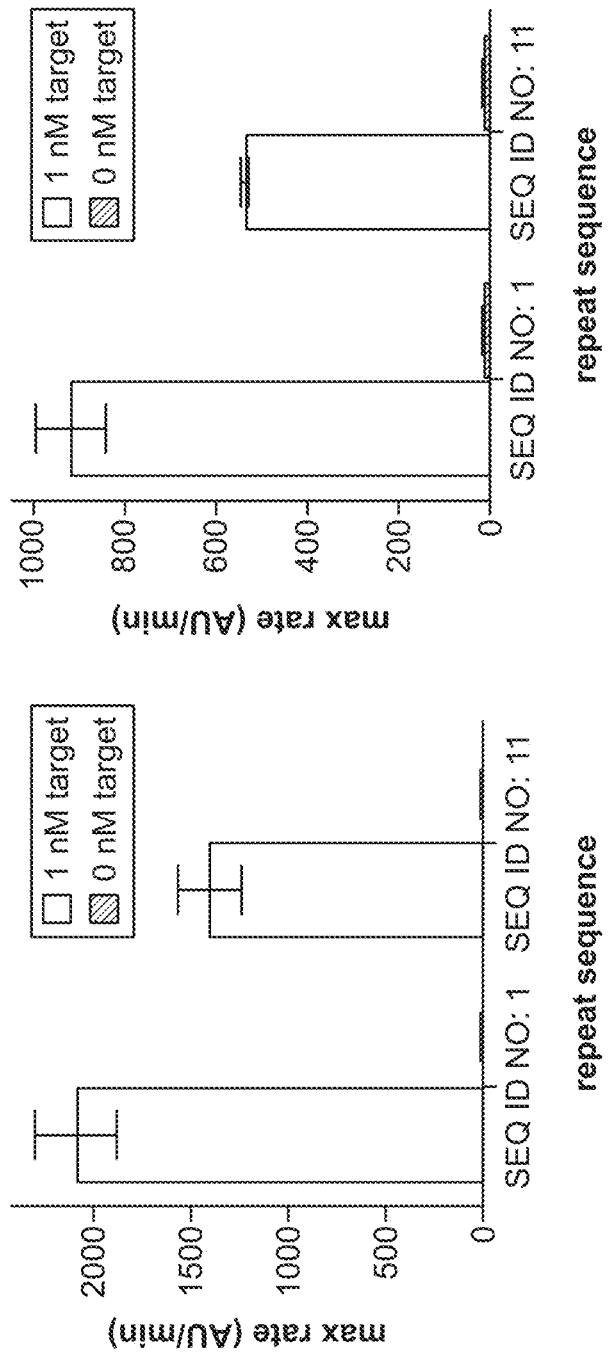

FIG. 93 shows the results of an assay comparing DETECTR assay efficiency for a Cas12 variant of SEQ ID NO: 11 with two different gRNAs. The gRNA contains either the LbCas12a repeat sequence ("gRNA #1," SEQ ID NO: 423, UAAUUUCUACUAAGUGUAGAUUCAU-CACGCAGCUCAUGCCC) or the Cas12 variant repeat sequence ("gRNA #2," SEQ ID NO: 424, GUUUGGUAC-CUUUAUUAAUUUCUACUAAGUGUAGAUUCAU-CACGCAGCUCAUGC CC). Figure discloses SEQ ID NOS 765-766, respectively, in order of appearance.

DETAILED DESCRIPTION

Disclosed herein are compositions, kits and methods related to improved Cas12 and other Cas protein activity. Through compositions and kits disclosed herein and practice of methods disclosed herein, one attains improved Cas activity such as Cas12 activity relative to Cas proteins in the art such as LbCas12a. Improved and in some cases high performance Cas12 proteins and conditions are disclosed herein.

The capability to quickly and accurately detect the presence of a target nucleic acid can provide valuable information associated with the presence of the target nucleic acid. For example, the capability to quickly and accurately detect the presence of an ailment provides valuable information and leads to actions to reduce the progression or transmission of the ailment. Detection of a target nucleic acid molecule encoding a specific sequence using a programmable nuclease provides a method for efficiently and accurately detecting the presence of the nucleic acid molecule of interest. There exists a need for highly efficient, rapid, and accurate reactions for detecting whether a target nucleic acid is present in a sample. The present disclosure provides compositions and methods for detecting a target nucleic acid in a sample using a programmable nuclease in a reaction. The reaction is sometimes referred to as a DETECTR reaction. The present disclosure provides various methods, reagents, enzymes, and kits for rapid tests, which may quickly assess whether a target nucleic acid is present in a sample by using a programmable nuclease that can detect the presence of a nucleic acid of interest (e.g., a deoxyribonucleic acid or a deoxyribonucleic acid amplicon of the nucleic acid of interest, which can be the target deoxyribonucleic acid) and generating a detectable signal indicating the presence of said nucleic acid of interest. The methods or reagents may be used as a point of care diagnostic or as a lab test for detection of a target nucleic acid and, thereby, detection of a condition in a subject from which the sample was taken. The methods or reagents may be used in various sites or locations, such as in laboratories, in hospitals, in physician offices/laboratories (POLs), in clinics, at remotes sites, or at home. Sometimes, the present disclosure provides various devices, systems, fluidic devices, and kits for consumer genetic use or for over the counter use.

The methods of the present disclosure include providing a programmable nuclease and a guide nucleic acid, wherein the guide nucleic acid is reverse complementary to a target nucleic acid of interest. The target nucleic acid may be a segment of a nucleic acid sequence of interest. The target nucleic acid may be a gene or a segment of a gene. When the guide nucleic acid hybridizes to the target nucleic acid of interest, the programmable nuclease is activated and exhibits sequence-independent cleavage of a nucleic acid of a reporter. The reporter further comprises a detection moiety, which is released upon sequence-independent cleavage of the nucleic acid of the reporter, and produces a detectable signal. The detectable signal can be measured and quantified to determine the presence or absence of the target nucleic acid in the sample and further quantify the target nucleic acid when present.

Detecting target nucleic acids in a sample using these methods is highly unpredictable, as the reaction itself can comprise reagents that inhibit sequence-independent cleavage by an activated programmable nuclease. For example, a sample comprising the target nucleic acid may first need to be lysed. The sample can be further subject to various sample prep steps including filtration, amplification, reverse transcription, and in vitro transcription. Each of these steps can allow for reagents that may inhibit an activated programmable nuclease from sequence independent cleavage of the nucleic acid of a reporter, thereby dampening the detectable signal. As one example, enzymes and/or salts in the buffers for lysing a sample may inhibit an activated programmable nuclease from sequence independent cleavage of the nucleic acid of a reporter. As another example, salts in the buffer for amplification, reverse transcription, and/or transcription of a target nucleic acid may inhibit an activated programmable nuclease from sequence independent cleavage of the nucleic acid of a reporter. As another example, the pH in the buffer of the unlysed sample, the lysis buffer, or the buffer for amplification, reverse transcription, and/or transcription of a target nucleic acid may inhibit an activated programmable nuclease from sequence independent cleavage of the nucleic acid of a reporter. In yet another example, amplification of a target nucleic acid comprises excess primer and may generate ssDNA that outcompete the nucleic acid of a reporter for cleavage by the activated programmable nuclease, thereby dampening the detectable signal. The compositions and methods disclosed herein identify volumes of the detection reaction to volumes of the sample, which provide for a strong detectable signal (in the presence of the target nucleic acid), thereby alleviating dampened detectable signals. The compositions and methods disclosed herein also identify ratios of the nucleic acid of the reporter to target and non-target nucleic acids, which provide for a strong detectable signal (in the presence of the target nucleic acid), thereby alleviating dampened detectable signals.

Also disclosed herein are methods of assaying for a target nucleic acid. The compositions, kits and methods related to improved Cas12 and other Cas protein activity may be implemented in methods of assaying for a target nucleic acid. In some embodiments, a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids (also referred to herein as "nucleic acid of the reporter") of a population of detector nucleic acids, wherein the cleavage indicates a presence of the target nucleic acid in the sample and wherein absence of the cleavage indicates an absence of the target nucleic acid in the sample. The target nucleic acid can be from 0.05% to 20% of total nucleic acids in the sample. Sometimes, the target nucleic acid is from 0.1% to 10% of the total nucleic acids in the sample. The target nucleic acid, in some cases, is from 0.1% to 5% of the total nucleic acids in the sample. Often, a sample comprises the segment of the target nucleic acid and at least one nucleic acid comprising less than 100% sequence identity to the segment of the target nucleic acid but no less than 50% sequence identity to the segment of the target nucleic acid. For example, the segment of the target nucleic acid comprises a mutation as compared to at least one nucleic acid comprising less than 100% sequence identity to the segment of the target nucleic acid but no less than 50% sequence identity to the segment of the target nucleic acid. Often, the segment of the target nucleic acid comprises a single nucleotide mutation as compared to at least one nucleic acid comprising less than 100% sequence identity to the segment of the target nucleic acid but no less than 50% sequence identity to the segment of the target nucleic acid.

The segment of the target nucleic acid often comprises a single nucleotide mutation wherein the single nucleotide mutation comprises a single nucleotide polymorphism (SNP), which is a single base pair variation in a DNA sequence present in less than 1% of a population. Sometimes, the segment of the target nucleic acid comprises a single nucleotide mutation, wherein the single nucleotide mutation comprises the wild type variant of the SNP. The single nucleotide mutation or SNP can be associated with a phenotype of the sample or a phenotype of the organism from which the sample was taken. The SNP, in some cases, is associated with altered phenotype from wild type phenotype. Often, the single nucleotide mutation or SNP is associated with a disease such as cancer or a genetic disorder. The single nucleotide mutation or SNP can be encoded in the sequence of a target nucleic acid from the germline of an organism or can be encoded in a target nucleic acid from a diseased cell, such as a cancer cell. The SNP can be a synonymous substitution or a nonsynonymous substitution. The nonsynonymous substitution can be a missense substitution or a nonsense point mutation. The synonymous substitution can be a silent substitution (e.g., a substitution which does not change the amino acid sequence of an encoded protein). The segment of the target nucleic acid often comprises a deletion, for example a deletion of one or more base pairs from an exon sequence. The deletion can be associated with a phenotype of the sample or a phenotype of the organism from which the sample was taken. The deletion, in some cases, is associated with altered phenotype from wild type phenotype. Often, the deletion is associated with a disease such as cancer or a genetic disorder. The deletion can be encoded in the sequence of a target nucleic acid from the germline of an organism or can be encoded in a target nucleic acid from a diseased cell, such as a cancer cell. The target nucleic acid can be DNA or RNA. Assaying of a target nucleic acid can be used to diagnose or identify diseases associated with target nucleic acid. The methods described herein use a programmable nuclease, such as the CRISPR/Cas system, to detect a target nucleic acid.

Often, a method disclosed herein comprises: contacting a programmable nuclease comprising a polypeptide having endonuclease activity and a guide nucleic acid to a target nucleic acid in a buffer comprising heparin. The heparin is present, for example, at a concentration of from 1 to 100 µg/ml heparin. Often, the heparin is present at a concentration of from 40 to 60 µg/ml heparin. Sometimes, the heparin is present at a concentration 50 µg/ml heparin. Often, the buffer comprises NaCl. The NaCl is present, for example, at a concentration of from 1 to 200 mM NaCl. Sometimes, the NaCl is present at a concentration of from 80 to 120 mM NaCl. Often, the NaCl is present at a concentration of 100 mM NaCl. The target nucleic acid can be a substrate target nucleic acid. Sometimes, the substrate nucleic acid comprises a cancer allele. Often, the cancer allele is present at a low concentration relative to a wild type allele. Sometimes, the substrate target nucleic acid comprises a splice variant. The substrate target nucleic acid often comprises an edited base. The substrate target nucleic acid sometimes comprises a bisulfate-treated base. Often, the substrate target nucleic acid comprises a segment that is reverse complementary to a segment of the guide nucleic acid.

Assaying of a target nucleic acid comprising a single nucleotide mutation can be difficult, especially in the presence of a nucleic acid comprising a variant of the single nucleotide mutation because there is only one nucleotide difference between the sequences of these nucleic acids. Additionally, it is often difficult to assay for the target nucleic acid comprising the single nucleotide mutation when the sample comprising the target nucleic acid also comprises more of the nucleic acid comprising the variant of the single nucleotide mutation than the target nucleic acid comprising the single nucleotide mutation. Often, the variant is the wild type variant of the single nucleotide mutation. Sometimes, the single nucleotide mutation is the wild variant of a SNP.

The methods described herein can enhance the assay detection a target nucleic acid. For example, a buffer comprising heparin and NaCl increases the discrimination of a programmable nuclease between the target nucleic acid comprising a single nucleotide mutation and other nucleic acids comprising a variant of the single nucleotide mutation.

Amplification methods can also enhance the assay detection of the target nucleic acid. For example, a PAM target nucleic acid comprising a sequence encoding a PAM sequence (e.g., TTTN or dUdUdUN) is produced by amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product. Often, the primer is the forward primer comprises the sequence encoding the PAM and has 1-8 nucleotides from the 3' end of the sequence encoding the PAM. Often, the single nucleotide mutation in the target nucleic acid sequence is 5-9 nucleotides downstream of the 5' end of the target nucleic acid segment wherein the target nucleic acid segment is a segment that binds to a segment of the guide nucleic acid that is reverse complementary to it and comprises the sequence encoding the PAM. Additional amplification strategies for enhancing the assay detection of the target nucleic acid include, but are not limited to, amplification with a blocking primer, wherein the blocking primer binds to variant of the single nucleotide mutation of the target nucleic acid, co-amplification at lower denaturation temperature-PCR (COLD-PCR), such as full COLD-PCR and fast COLD-PCR, allele-specific PCR, targeting the nucleic acids comprising a variant of the single nucleotide mutation with a protein allowing for their removal, or targeting the target nucleic acids with a protein allowing for the removal of the other nucleic acids, or any combination thereof.

Further disclosed herein are methods of assaying for a target nucleic acid, wherein the target nucleic acid segment lacks a PAM sequence. For example, a method of assaying for a target nucleic acid in a sample comprising: producing a PAM target nucleic acid comprising a sequence encoding a PAM by amplifying the target nucleic acid of the sample using primers comprising the encoding the PAM; contacting the PAM target nucleic acid to a complex comprising a guide nucleic acid comprising a segment that is reverse complementary to a segment of the PAM target nucleic acid and a programmable nuclease that exhibits sequence independent cleavage upon forming a complex comprising the segment of the guide nucleic acid binding to the segment of the PAM target nucleic acid; and assaying for a signal indicating cleavage of at least some detector nucleic acids of a population of detector nucleic acids, wherein the signal indicates a presence of the target nucleic acid in the sample and wherein the absence of the signal indicates an absence of the target nucleic acid in the sample. Sometimes, a method of assaying for a target nucleic acid segment in a sample, wherein the target nucleic acid segment lacks a PAM sequence, comprises amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample. The sequence encoding the PAM can comprise TTTN. Sometimes, the sequence encoding the PAM comprises dUdUdUN. Often, a forward primer of the primers comprises the sequence encoding the PAM and has one to ten nucleotides from the 3' end of the sequence encoding the PAM. These nucleotides can be referred to as extension nucleotides. In some embodiments, extensions with 10 nucleotides or fewer may produce specific detection with the guide RNA. In some embodiments, extensions with greater than 12 nucleotides may self-activate, resulting in reduced detection specificity for the target sequence. Extensions between 5 nucleotides and 10 nucleotides may provide sufficient overlap with the target sequence to anneal to the target sequence with an annealing temperature amenable to detection. In some embodiments, an extension may comprise 4, 5, 6, 7, 8, 9, or 10 nucleotides from the 3' end of the sequence encoding the PAM. Sometimes, a mismatch for single nucleotide polymorphism (SNP) detection is 3-10 nucleotides downstream of the PAM in PAM target nucleic acid. This allows for detection of any target nucleic acid by a programmable nuclease. The methods described herein use a programmable nuclease, such as the CRISPR/Cas system, to detect a target nucleic acid. Often, the programmable nuclease is Cas12.

A target nucleic acid is required to have a PAM sequence for binding and trans cleavage activation of some programmable nucleases complexed with a guide nucleic acid. However, there are many target nucleic acids of interest that do not encode for the PAM sequence. Therefore, there is a need for strategies to allow for binding and trans cleavage activation of the programmable nucleases complexed with a guide nucleic acid using any target nucleic sequence of interest.

The methods describe herein use amplification techniques to insert a PAM sequence into the target nucleic acid for recognition by the programmable nuclease complexed with the guide nucleic acid.

Sample

A number of samples are consistent with the compositions and methods disclosed herein. The samples, as described herein, are compatible with the DETECTR assay methods disclosed herein. The samples, as described herein, are compatible with any of the programmable nucleases disclosed herein (e.g., a programmable nuclease with at least 60% sequence identity to SEQ ID NO: 11) and use of said programmable nuclease in a method of detecting a target nucleic acid. The samples, as described herein, are compatible with any of the compositions comprising a programmable nuclease and a buffer, which has been developed to improve the function of the programmable nuclease (e.g., a programmable nuclease and a buffer with low salt (about 110 mM or less) and a pH of 7 to 8) and use of said compositions in a method of detecting a target nucleic acid. The samples, as described herein, are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence.

Described herein are sample that contain deoxyribonucleic acid (DNA), ribonucleic acid (RNA), or both, which can be detected using a programmable nuclease, such as a Type V CRISPR/Cas enzyme (e.g., a Cas12 such as Cas12 is a Cas12a, Cas12b, Cas12c, Cas12d (also referred to as CasY), or Cas12e or a Cas14 such as Cas14a, Cas14b, Cas14c, Cas14d, Cas14e, Cas14f, Cas14g, or Cas14h) or a Type VI CRISPR enzyme (e.g., a Cas13 such as Cas13a, Cas13b, Cas13c, Cas13d, or Cas13e). As described herein, programmable nucleases are activated upon binding to a target nucleic acid of interest in a sample upon hybridization of a guide nucleic acid to the target nucleic acid. Subsequently, the activated programmable nucleases exhibit sequence-independent cleavage of a nucleic acid in a reporter. The reporter additionally includes a detectable moiety, which is released upon sequence-independent cleavage of the nucleic acid in the reporter. The detectable moiety emits a detectable signal, which can be measured by various methods (e.g., spectrophotometry, fluorescence measurements, electrochemical measurements).

Various sample types comprising a target nucleic acid of interest are consistent with the present disclosure. These samples can comprise a target nucleic acid sequence for detection. In some embodiments, the detection of the target nucleic indicates an ailment, such as a disease, cancer, or genetic disorder, or genetic information, such as for phenotyping, genotyping, or determining ancestry and are compatible with the reagents and support mediums as described herein. Generally, a sample from an individual or an animal or an environmental sample can be obtained to test for presence of a disease, cancer, genetic disorder, or any mutation of interest. A biological sample from the individual may be blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. A tissue sample may be dissociated or liquified prior to application to detection system of the present disclosure. A sample from an environment may be from soil, air, or water. In some instances, the environmental sample is taken as a swab from a surface of interest or taken directly from the surface of interest. In some instances, the raw sample is applied to the detection system. In some instances, the sample is diluted with a buffer or a fluid or concentrated prior to application to the detection system or be applied neat to the detection system. Sometimes, the sample is contained in no more 20 µl. The sample, in some cases, is contained in no more than 1, 5, 10, 15, 20, 25, 30, 35 40, 45, 50, 55, 60, 65, 70, 75, 80, 90, 100, 200, 300, 400, 500 µl, or any of value from 1 µl to 500 µl, preferably from 10 µL to 200 µL, or more preferably from 50 µL to 100 µL. Sometimes, the sample is contained in more than 500 µl.

In some embodiments, the target nucleic acid is single-stranded DNA. The methods, reagents, enzymes, and kits disclosed herein may enable the direct detection of a DNA encoding a sequence of interest, in particular a single-stranded DNA encoding a sequence of interest, without transcribing the DNA into RNA, for example, by using an RNA polymerase. The compositions and methods disclosed herein may enable the detection of target nucleic acid that is an amplified nucleic acid of a nucleic acid of interest. In some embodiments, the target nucleic acid is a cDNA, genomic DNA, an amplicon of genomic DNA or a DNA amplicon of an RNA. A nucleic acid can encode a sequence from a genomic locus. In some cases, the target nucleic acid that binds to the guide nucleic acid is from 5 to 100, 5 to 90, 5 to 80, 5 to 70, 5 to 60, 5 to 50, 5 to 40, 5 to 30, 5 to 25, 5 to 20, 5 to 15, or 5 to 10 nucleotides in length. The nucleic acid can be from 10 to 90, from 20 to 80, from 30 to 70, or from 40 to 60 nucleotides in length. A nucleic acid can be 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 60, 70, 80, 90, or 100 nucleotides in length. The target nucleic acid can encode a sequence reverse complementary to a guide nucleic acid sequence.

In some instances, the sample is taken from single-cell eukaryotic organisms; a plant or a plant cell; an algal cell; a fungal cell; an animal cell, tissue, or organ; a cell, tissue, or organ from an invertebrate animal; a cell, tissue, fluid, or organ from a vertebrate animal such as fish, amphibian, reptile, bird, and mammal; a cell, tissue, fluid, or organ from a mammal such as a human, a non-human primate, an ungulate, a feline, a bovine, an ovine, and a caprine. In some instances, the sample is taken from nematodes, protozoans, helminths, or malarial parasites. In some cases, the sample comprises nucleic acids from a cell lysate from a eukaryotic cell, a mammalian cell, a human cell, a prokaryotic cell, or a plant cell. In some cases, the sample comprises nucleic acids expressed from a cell.

The sample described herein may comprise at least one target nucleic acid. The target nucleic acid comprises a segment that is reverse complementary to a segment of a guide nucleic acid. Often, the sample comprises the segment of the target nucleic acid and at least one nucleic acid comprising at least 50% sequence identity to a segment of the target nucleic acid. Sometimes, the at least one nucleic acid comprises a segment comprising at least 60%, 70%, 75%, 80%, 85%, 90%, 91%, 92%, 93%, 94%, 95%, 96%, 97%, 98%, or 99% sequence identity to the segment of the target nucleic acid. Often, a sample comprises the segment of the target nucleic acid and at least one nucleic acid a segment comprising less than 100% sequence identity to the target nucleic acid but no less than 50% sequence identity to the segment of the target nucleic acid. Sometimes, a sample comprises the segment of the target nucleic acid and at least one nucleic acid a segment comprising less than 100% sequence identity to the target nucleic acid but no less than 60%, 70%, 75%, 80%, 85%, 90%, 91%, 92%, 93%, 94%, 95%, 96%, 97%, 98%, or 99% sequence identity to the segment of the target nucleic acid. For example, the segment of the target nucleic acid comprises a mutation as compared to at least one nucleic acid comprising a segment comprising less than 100% sequence identity to the segment of the target nucleic acid but no less than 50% sequence identity to the segment of the target nucleic acid. Sometimes, the segment of the target nucleic acid comprises a mutation as compared to at least one nucleic acid comprising a segment comprising less than 100% sequence identity to the segment of the target nucleic acid but no less than 60%, 70%, 75%, 80%, 85%, 90%, 91%, 92%, 93%, 94%, 95%, 96%, 97%, 98%, or 99% sequence identity to the segment of the target nucleic acid. Often, the segment of the target nucleic acid comprises a mutation as compared to at least one nucleic acid comprising a segment comprising less than 100% sequence identity to the segment of the target nucleic acid but no less than 50% sequence identity to the segment of the target nucleic acid. The mutation can be a mutation of 1, 2, 3, 4, 5, 6, 7, 8, 9, 10, 11, 12, 13, 14, 15, 16, 17, 18, 19, 20 or more nucleotides. Often, the mutation is a single nucleotide mutation. The single nucleotide mutation can be a single nucleotide polymorphism (SNP), which is a single base pair variation in a DNA sequence present in less than 1% of a population. Sometimes, the target nucleic acid comprises a single nucleotide mutation, wherein the single nucleotide mutation comprises the wild type variant of the SNP. The single nucleotide mutation or SNP can be associated with a phenotype of the sample or a phenotype of the organism from which the sample was taken. The SNP, in some cases, is associated with altered phenotype from wild type phenotype. Often, the segment of the target nucleic acid sequence comprises a deletion as compared to at least one nucleic acid comprising a segment comprising less than 100% sequence identity to the segment of the target nucleic acid but no less than 50% sequence identity to the segment of the target nucleic acid. The mutation can be a deletion of 1, 2, 3, 4, 5, 6, 7, 8, 9, 10, 11, 12, 13, 14, 15, 16, 17, 18, 19, 20 or more nucleotides. The mutation can be a deletion of about 5, about 10, about 15, about 20, about 25, about 30, about 35, about 40, about 45, about 50, about 55, about 60, about 65, about 70, about 75, about 80, about 85, about 90, about 95, about 100, about 200, about 300, about 400, about 500, about 600, about 700, about 800, about 900, or about 1000 nucleotides. The mutation can be a deletion of from 1 to 5, from 5 to 10, from 10 to 15, from 15 to 20, from 20 to 25, from 25 to 30, from 30 to 35, from 35 to 40, from 40 to 45, from 45 to 50, from 50 to 55, from 55 to 60, from 60 to 65, from 65 to 70, from 70 to 75, from 75 to 80, from 80 to 85, from 85 to 90, from 90 to 95, from 95 to 100, from 100 to 200, from 200 to 300, from 300 to 400, from 400 to 500, from 500 to 600, from 600 to 700, from 700 to 800, from 800 to 900, from 900 to 1000, from 1 to 50, from 1 to 100, from 25 to 50, from 25 to 100, from 50 to 100, from 100 to 500, from 100 to 1000, or from 500 to 1000 nucleotides. The segment of the target nucleic acid that the guide nucleic acid of the methods describe herein binds to comprises the mutation, such as the SNP or the deletion. The mutation can be a single nucleotide mutation or a SNP. The SNP can be a synonymous substitution or a nonsynonymous substitution. The nonsynonymous substitution can be a missense substitution or a nonsense point mutation. The synonymous substitution can be a silent substitution. The mutation can be a deletion of one or more nucleotides. Often, the single nucleotide mutation, SNP, or deletion is associated with a disease such as cancer or a genetic disorder. The mutation, such as a single nucleotide mutation, a SNP, or a deletion, can be encoded in the sequence of a target nucleic acid from the germline of an organism or can be encoded in a target nucleic acid from a diseased cell, such as a cancer cell.

The sample used for disease testing may comprise at least one target nucleic acid that can bind to a guide nucleic acid of the reagents described herein. The sample used for disease testing may comprise at least nucleic acid of interest that is amplified to produce a target nucleic acid that can bind to a guide nucleic acid of the reagents described herein. The nucleic acid of interest can comprise DNA, RNA, or a combination thereof.

The target nucleic acid (e.g., a target DNA) may be a portion of a nucleic acid from a virus or a bacterium or other agents responsible for a disease in the sample. The target nucleic acid may be a portion of a nucleic acid from a gene expressed in a cancer or genetic disorder in the sample. In some cases, the sequence is a segment of a target nucleic acid sequence. A segment of a target nucleic acid sequence can be from a genomic locus, a transcribed mRNA, or a reverse transcribed cDNA. A segment of a target nucleic acid sequence can be from 5 to 100, 5 to 90, 5 to 80, 5 to 70, 5 to 60, 5 to 50, 5 to 40, 5 to 30, 5 to 25, 5 to 20, 5 to 15, or 5 to 10 nucleotides in length. A segment of a target nucleic acid sequence can be 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 60, 70, 80, 90, or 100 nucleotides in length. The sequence of the target nucleic acid segment can be reverse complementary to a segment of a guide nucleic acid sequence. The target nucleic acid may comprise a genetic variation (e.g., a single nucleotide polymorphism), with respect to a standard sample, associated with a disease phenotype or disease predisposition. The target nucleic acid may be an amplicon of a portion of an RNA, may be a DNA, or may be a DNA amplicon from any organism in the sample.

In some embodiments, the target nucleic acid sequence comprises a nucleic acid sequence of a virus or a bacterium or other agents responsible for a disease in the sample. In some embodiments, the target nucleic acid comprises DNA that is reverse transcribed from RNA using a reverse transcriptase prior to detection by a programmable nuclease using the compositions, systems, and methods disclosed herein. The target nucleic acid, in some cases, is a portion of a nucleic acid from a sexually transmitted infection or a contagious disease, in the sample. In some cases, the target nucleic acid is a portion of a nucleic acid from a genomic locus, or any DNA amplicon, such as a reverse transcribed mRNA or a cDNA from a gene locus, a transcribed mRNA, or a reverse transcribed cDNA from a gene locus in at least one of: human immunodeficiency virus (HIV), human papillomavirus (HPV), chlamydia, gonorrhea, syphilis, trichomoniasis, sexually transmitted infection, malaria, Dengue fever, Ebola, chikungunya, and leishmaniasis. Pathogens include viruses, fungi, helminths, protozoa, malarial parasites, *Plasmodium* parasites, *Toxoplasma* parasites, and *Schistosoma* parasites. Helminths include roundworms, heartworms, and phytophagous nematodes, flukes, Acanthocephala, and tapeworms. Protozoan infections include infections from *Giardia* spp., *Trichomonas* spp., African trypanosomiasis, amoebic dysentery, babesiosis, balantidial dysentery, Chaga's disease, coccidiosis, malaria and toxoplasmosis. Examples of pathogens such as parasitic/protozoan pathogens include, but are not limited to: *Plasmodium falciparum, P. vivax, Trypanosoma cruzi* and *Toxoplasma gondii*. Fungal pathogens include, but are not limited to *Cryptococcus neoformans, Histoplasma capsulatum, Coccidioides immitis, Blastomyces dermatitides, Chlamydia trachomatis*, and *Candida albicans*. Pathogenic viruses include but are not limited to immunodeficiency virus (e.g., HIV); influenza virus; dengue; West Nile virus; herpes virus; yellow fever virus; Hepatitis Virus C; Hepatitis Virus A; Hepatitis Virus B; papillomavirus; and the like. Pathogens include, e.g., HIV virus, *Mycobacterium tuberculosis, Streptococcus agalactiae*, methicillin-resistant *Staphylococcus aureus, Legionella pneumophila, Streptococcus pyogenes, Escherichia coli, Neisseria gonorrhoeae, Neisseria meningitidis*, Pneumococcus, *Cryptococcus neoformans, Histoplasma capsulatum, Hemophilus influenzae* B, *Treponema pallidum*, Lyme disease spirochetes, *Pseudomonas aeruginosa, Mycobacterium leprae, Brucella abortus*, rabies virus, influenza virus, cytomegalovirus, herpes simplex virus I, herpes simplex virus II, human serum parvo-like virus, respiratory syncytial virus (RSV), *M. genitalium, T. vaginalis*, varicella-zoster virus, hepatitis B virus, hepatitis C virus, measles virus, adenovirus, human T-cell leukemia viruses, Epstein-Barr virus, murine leukemia virus, mumps virus, vesicular stomatitis virus, Sindbis virus, lymphocytic choriomeningitis virus, wart virus, blue tongue virus, Sendai virus, feline leukemia virus, Reovirus, polio virus, simian virus 40, mouse mammary tumor virus, dengue virus, rubella virus, West Nile virus, *Plasmodium falciparum, Plasmodium vivax, Toxoplasma gondii, Trypanosoma rangeli, Trypanosoma cruzi, Trypanosoma rhodesiense, Trypanosoma brucei, Schistosoma mansoni, Schistosoma japonicum, Babesia bovis, Eimeria tenella, Onchocerca volvulus, Leishmania tropica, Mycobacterium tuberculosis, Trichinella spiralis, Theileria parva, Taenia hydatigena, Taenia ovis, Taenia saginata, Echinococcus granulosus, Mesocestoides corti, Mycoplasma arthritidis, M. hyorhinis, M. orale, M. arginini, Acholeplasma laidlawii, M. salivarium* and *M. pneumoniae*. In some cases, the target sequence is a portion of a nucleic acid from a genomic locus, a transcribed mRNA, or a reverse transcribed cDNA from a gene locus of bacterium or other agents responsible for a disease in the sample comprising a mutation that confers resistance to a treatment, such as a single nucleotide mutation that confers resistance to antibiotic treatment. In some cases, the mutation that confers resistance to a treatment is a deletion.

The sample used for cancer testing may comprise at least one target nucleic acid that can bind to a guide nucleic acid of the reagents described herein. The target nucleic acid, in some cases, comprises a portion of a gene comprising a mutation associated with cancer, a gene whose overexpression is associated with cancer, a tumor suppressor gene, an oncogene, a checkpoint inhibitor gene, a gene associated with cellular growth, a gene associated with cellular metabolism, or a gene associated with cell cycle. Sometimes, the target nucleic acid encodes a cancer biomarker, such as a prostate cancer biomarker or non-small cell lung cancer. In some cases, the assay can be used to detect "hotspots" in target nucleic acids that can be predictive of lung cancer. In some cases, the target nucleic acid comprises a portion of a nucleic acid that is associated with a blood fever. In some cases, the target nucleic acid is a portion of a nucleic acid from a genomic locus, any DNA amplicon of, a reverse transcribed mRNA, or a cDNA from a locus of at least one of: ALK, APC, ATM, AXIN2, BAP1, BARD1, BLM, BMPR1A, BRCA1, BRCA2, BRIP1, CASR, CDC73, CDH1, CDK4, CDKN1B, CDKN1C, CDKN2A, CEBPA, CHEK2, CTNNA1, DICER1, DIS3L2, EGFR, EPCAM, FH, FLCN, GATA2, GPC3, GREM1, HOXB13, HRAS, KIT, MAX, MEN1, MET, MITF, MLH1, MSH2, MSH3, MSH6, MUTYH, NBN, NF1, NF2, NTHL1, PALB2, PDGFRA, PHOX2B, PMS2, POLD1, POLE, POT1, PRKAR1A, PTCH1, PTEN, RAD50, RAD51C, RAD51D, RB1, RECQL4, RET, RUNX1, SDHA, SDHAF2, SDHB, SDHC, SDHD, SMAD4, SMARCA4, SMARCB1, SMARCE1, STK11, SUFU, TERC, TERT, TMEM127, TP53, TSC1, TSC2, VHL, WRN, and WT1. Any region of the aforementioned gene loci can be probed for a mutation or deletion using the compositions and methods disclosed herein. For example, in the EGFR gene locus, the compositions and methods for detection disclosed herein can be used to detect a single nucleotide polymorphism or a deletion. The SNP or deletion can occur in a non-coding region or a coding region. The SNP or deletion can occur in an Exon, such as Exon19.

The sample used for genetic disorder testing may comprise at least one target nucleic acid that can bind to a guide nucleic acid of the reagents described herein. In some embodiments, the genetic disorder is hemophilia, sickle cell anemia, β-thalassemia, Duchene muscular dystrophy, severe combined immunodeficiency, Huntington's disease, or cystic fibrosis. The target nucleic acid, in some cases, is from a gene with a mutation associated with a genetic disorder, from a gene whose overexpression is associated with a genetic disorder, from a gene associated with abnormal cellular growth resulting in a genetic disorder, or from a gene associated with abnormal cellular metabolism resulting in a genetic disorder. In some cases, the target nucleic acid is a nucleic acid from a genomic locus, a transcribed mRNA, or a reverse transcribed mRNA, a DNA amplicon of or a cDNA from a locus of at least one of: CFTR, FMR1, SMN1, ABCB11, ABCC8, ABCD1, ACAD9, ACADM, ACADVL, ACAT1, ACOX1, ACSF3, ADA, ADAMTS2, ADGRG1, AGA, AGL, AGPS, AGXT, AIRE, ALDH3A2, ALDOB, ALG6, ALMS1, ALPL, AMT, AQP2, ARG1, ARSA, ARSB, ASL, ASNS, ASPA, ASS1, ATM, ATP6V1B1, ATP7A, ATP7B, ATRX, BBS1, BBS10, BBS12, BBS2, BCKDHA, BCKDHB, BCS1L, BLM, BSND, CAPN3, CBS, CDH23, CEP290, CERKL, CHM, CHRNE, CIITA, CLN3, CLN5, CLN6, CLN8, CLRN1, CNGB3, COL27A1, COL4A3, COL4A4, COL4A5, COL7A1, CPS1, CPT1A, CPT2, CRB1, CTNS, CTSK, CYBA, CYBB, CYP11B1, CYP11B2, CYP17A1, CYP19A1, CYP27A1, DBT, DCLRE1C, DHCR7, DHDDS, DLD, DMD, DNAHS, DNAI1, DNAI2, DYSF, EDA, EIF2B5, EMD, ERCC6, ERCC8, ESCO2, ETFA, ETFDH, ETHE1, EVC, EVC2, EYS, F9, FAH, FAM161A, FANCA, FANCC, FANCG, FH, FKRP, FKTN, G6PC, GAA, GALC, GALK1, GALT, GAMT, GBA, GBE1, GCDH, GFM1, GJB1, GJB2, GLA, GLB1, GLDC, GLE1, GNE, GNPTAB, GNPTG, GNS, GRHPR, HADHA, HAX1, HBA1, HBA2, HBB, HEXA, HEXB, HGSNAT, HLCS, HMGCL, HOGA1, HPS1, HPS3, HSD17B4, HSD3B2, HYAL1, HYLS1, IDS, IDUA, IKBKAP, IL2RG, IVD, KCNJ11, LAMA2, LAMA3, LAMB3, LAMC2, LCAS, LDLR, LDLRAP1, LHX3, LIFR, LIPA, LOXHD1, LPL, LRPPRC, MAN2B1, MCOLN1, MED17, MESP2, MFSD8, MKS1, MLC1, MMAA, MMAB, MMACHC, MMADHC, MPI, MPL, MPV17, MTHFR, MTM1, MTRR, MTTP, MUT, MYO7A, NAGLU, NAGS, NBN, NDRG1, NDUFAFS, NDUFS6, NEB, NPC1, NPC2, NPHS1, NPHS2, NR2E3, NTRK1, OAT, OPA3, OTC, PAH, PC, PCCA, PCCB, PCDH15, PDHA1, PDHB, PEX1, PEX10, PEX12, PEX2, PEX6, PEX7, PFKM, PHGDH, PKHD1, PMM2, POMGNT1, PPT1, PROP1, PRPS1, PSAP, PTS, PUS1, PYGM, RAB23, RAG2, RAPSN, RARS2, RDH12, RMRP, RPE65, RPGRIP1L, RS1, RTEL1, SACS, SAMHD1, SEPSECS, SGCA, SGCB, SGCG, SGSH, SLC12A3, SLC12A6, SLC17A5, SLC22A5, SLC25A13, SLC25A15, SLC26A2, SLC26A4, SLC35A3, SLC37A4, SLC39A4, SLC4A11, SLC6A8, SLC7A7, SMARCAL1, SMPD1, STAR, SUMF1, TAT, TCIRG1, TECPR2, TFR2, TGM1, TH, TMEM216, TPP1, TRMU, TSFM, TTPA, TYMP, USH1C, USH2A, VPS13A, VPS13B, VPS45, VRK1, VSX2, WNT10A, XPA, XPC, and ZFYVE26.

The sample used for phenotyping testing may comprise at least one target nucleic acid that can bind to a guide nucleic acid of the reagents described herein. The target nucleic acid, in some cases, is a nucleic acid encoding a sequence associated with a phenotypic trait.

The sample used for genotyping testing may comprise at least one target nucleic acid that can bind to a guide nucleic acid of the reagents described herein. The target nucleic acid, in some cases, is a nucleic acid encoding a sequence associated with a genotype of interest.

The sample used for ancestral testing may comprise at least one target nucleic acid that can bind to a guide nucleic acid of the reagents described herein. The target nucleic acid, in some cases, is a nucleic acid encoding a sequence associated with a geographic region of origin or ethnic group.

The sample can be used for identifying a disease status. For example, a sample is any sample described herein, and is obtained from a subject for use in identifying a disease status of a subject. The disease can be a cancer or genetic disorder. Sometimes, a method comprises obtaining a serum sample from a subject; and identifying a disease status of the subject. Often, the disease status is prostate disease status.

In some instances, the target nucleic acid is a single stranded nucleic acid. Alternatively or in combination, the target nucleic acid is a double stranded nucleic acid and is prepared into single stranded nucleic acids before or upon contacting the reagents. The target nucleic acid may be a reverse transcribed RNA, DNA, DNA amplicon, synthetic nucleic acids, or nucleic acids found in biological or environmental samples. The target nucleic acids include but are not limited to mRNA, rRNA, tRNA, non-coding RNA, long non-coding RNA, and microRNA (miRNA). In some cases, the target nucleic acid is single-stranded DNA (ssDNA) or mRNA. In some cases, the target nucleic acid is from a virus, a parasite, or a bacterium described herein. In some cases, the target nucleic acid is transcribed from a gene as described herein and then reverse transcribed into a DNA amplicon.

A number of target nucleic acids are consistent with the methods and compositions disclosed herein. Some methods described herein can detect a target nucleic acid present in the sample in various concentrations or amounts as a target nucleic acid population. In some cases, the sample has at least 2 target nucleic acids. In some cases, the sample has at least 3, 5, 10, 20, 30, 40, 50, 100, 200, 300, 400, 500, 600, 700, 800, 900, 1000, 2000, 3000, 4000, 5000, 6000, 7000, 8000, 9000, or 10000 target nucleic acids. In some cases, the sample as from 1 to 10,000, from 100 to 8000, from 400 to 6000, from 500 to 5000, from 1000 to 4000, or from 2000 to 3000 target nucleic acids. In some cases, the method detects target nucleic acid present at least at one copy per 10 non-target nucleic acids, $10^2$ non-target nucleic acids, $10^3$ non-target nucleic acids, $10^4$ non-target nucleic acids, $10^5$ non-target nucleic acids, $10^6$ non-target nucleic acids, $10^7$ non-target nucleic acids, $10^8$ non-target nucleic acids, $10^9$ non-target nucleic acids, or $10^{10}$ non-target nucleic acids. Often, the target nucleic acid can be from 0.05% to 20% of total nucleic acids in the sample. Sometimes, the target nucleic acid is from 0.1% to 10% of the total nucleic acids in the sample. The target nucleic acid, in some cases, is from 0.1% to 5% of the total nucleic acids in the sample. The target nucleic acid can also be from 0.1% to 1% of the total nucleic acids in the sample. The target nucleic acid can be DNA or RNA. The target nucleic acid can be any amount less than 100% of the total nucleic acids in the sample. The target nucleic acid can be 100% of the total nucleic acids in the sample.

In some embodiments, the sample comprises a target nucleic acid at a concentration of less than 1 nM, less than 2 nM, less than 3 nM, less than 4 nM, less than 5 nM, less than 6 nM, less than 7 nM, less than 8 nM, less than 9 nM, less than 10 nM, less than 20 nM, less than 30 nM, less than 40 nM, less than 50 nM, less than 60 nM, less than 70 nM, less than 80 nM, less than 90 nM, less than 100 nM, less than 200 nM, less than 300 nM, less than 400 nM, less than 500 nM, less than 600 nM, less than 700 nM, less than 800 nM, less than 900 nM, less than 1 µM, less than 2 µM, less than 3 µM, less than 4 µM, less than 5 µM, less than 6 µM, less than 7 µM, less than 8 µM, less than 9 µM, less than 10 µM, less than 100 µM, or less than 1 mM. In some embodiments, the sample comprises a target nucleic acid sequence at a concentration of from 1 nM to 2 nM, from 2 nM to 3 nM, from 3 nM to 4 nM, from 4 nM to 5 nM, from 5 nM to 6 nM, from 6 nM to 7 nM, from 7 nM to 8 nM, from 8 nM to 9 nM, from 9 nM to 10 nM, from 10 nM to 20 nM, from 20 nM to 30 nM, from 30 nM to 40 nM, from 40 nM to 50 nM, from 50 nM to 60 nM, from 60 nM to 70 nM, from 70 nM to 80 nM, from 80 nM to 90 nM, from 90 nM to 100 nM, from 100 nM to 200 nM, from 200 nM to 300 nM, from 300 nM to 400 nM, from 400 nM to 500 nM, from 500 nM to 600 nM, from 600 nM to 700 nM, from 700 nM to 800 nM, from 800 nM to 900 nM, from 900 nM to 1 µM, from 1 µM to 2 µM, from 2 µM to 3 µM, from 3 µM to 4 µM, from 4 µM to 5 µM, from 5 µM to 6 µM, from 6 µM to 7 µM, from 7 µM to 8 µM, from 8 µM to 9 µM, from 9 µM to 10 µM, from 10 µM to 100 µM, from 100 µM to 1 mM, from 1 nM to 10 nM, from 1 nM to 100 nM, from 1 nM to 1 µM, from 1 nM to 10 µM, from 1 nM to 100 µM, from 1 nM to 1 mM, from 10 nM to 100 nM, from 10 nM to 1 µM, from 10 nM to 10 µM, from 10 nM to 100 µM, from 10 nM to 1 mM, from 100 nM to 1 µM, from 100 nM to 10 µM, from 100 nM to 100 µM, from 100 nM to 1 mM, from 1 µM to 10 µM, from 1 µM to 100 µM, from 1 µM to 1 mM, from 10 µM to 100 µM, from 10 µM to 1 mM, or from 100 µM to 1 mM. In some embodiments, the sample comprises a target nucleic acid at a concentration of from 20 nM to 200 µM, from 50 nM to 100 µM, from 200 nM to 50 µM, from 500 nM to 20 µM, or from 2 µM to 10 µM. In some embodiments, the target nucleic acid is not present in the sample.

In some embodiments, the sample comprises fewer than 10 copies, fewer than 100 copies, fewer than 1000 copies, fewer than 10,000 copies, fewer than 100,000 copies, or fewer than 1,000,000 copies of a target nucleic acid sequence. In some embodiments, the sample comprises from 10 copies to 100 copies, from 100 copies to 1000 copies, from 1000 copies to 10,000 copies, from 10,000 copies to 100,000 copies, from 100,000 copies to 1,000,000 copies, from 10 copies to 1000 copies, from 10 copies to 10,000 copies, from 10 copies to 100,000 copies, from 10 copies to 1,000,000 copies, from 100 copies to 10,000 copies, from 100 copies to 100,000 copies, from 100 copies to 1,000,000 copies, from 1,000 copies to 100,000 copies, or from 1,000 copies to 1,000,000 copies of a target nucleic acid sequence. In some embodiments, the sample comprises from 10 copies to 500,000 copies, from 200 copies to 200,000 copies, from 500 copies to 100,000 copies, from 1000 copies to 50,000 copies, from 2000 copies to 20,000 copies, from 3000 copies to 10,000 copies, or from 4000 copies to 8000 copies. In some embodiments, the target nucleic acid is not present in the sample.

A number of target nucleic acid populations are consistent with the methods and compositions disclosed herein. Some methods described herein can detect two or more target nucleic acid populations present in the sample in various concentrations or amounts. In some cases, the sample has at least 2 target nucleic acid populations. In some cases, the sample has at least 3, 4, 5, 6, 7, 8, 9, 10, 20, 30, 40, or 50 target nucleic acid populations. In some cases, the sample has from 3 to 50, from 5 to 40, or from 10 to 25 target nucleic acid populations. In some cases, the method detects target nucleic acid populations that are present at least at one copy per $10^1$ non-target nucleic acids, $10^2$ non-target nucleic acids, $10^3$ non-target nucleic acids, $10^4$ non-target nucleic acids, $10^5$ non-target nucleic acids, $10^6$ non-target nucleic acids, $10^7$ non-target nucleic acids, $10^8$ non-target nucleic acids, $10^9$ non-target nucleic acids, or $10^{10}$ non-target nucleic acids. The target nucleic acid populations can be present at different concentrations or amounts in the sample.

Additionally, target nucleic acid can be an amplified nucleic acid of interest, which can bind to the guide nucleic acid of a programmable nuclease, such as a DNA-activated programmable RNA nuclease. The nucleic acid of interest may be any nucleic acid disclosed herein or from any sample as disclosed herein. This amplification can be thermal amplification (e.g., using PCR) or isothermal amplification. This nucleic acid amplification of the sample can improve at least one of sensitivity, specificity, or accuracy of the detection the target nucleic acid. The reagents for nucleic acid amplification can comprise a recombinase, a oligonucleotide primer, a single-stranded DNA binding (SSB) protein, and a polymerase. The nucleic acid amplification can be transcription mediated amplification (TMA). Nucleic acid amplification can be helicase dependent amplification (HDA) or circular helicase dependent amplification (cHDA). In additional cases, nucleic acid amplification is strand displacement amplification (SDA). The nucleic acid amplification can be recombinase polymerase amplification (RPA). The nucleic acid amplification can be at least one of loop mediated amplification (LAMP) or the exponential amplification reaction (EXPAR). Nucleic acid amplification is, in some cases, by rolling circle amplification (RCA), ligase chain reaction (LCR), simple method amplifying RNA targets (SMART), single primer isothermal amplification (SPIA), multiple displacement amplification (MDA), nucleic acid sequence based amplification (NASBA), hinge-initiated primer-dependent amplification of nucleic acids (HIP), nicking enzyme amplification reaction (NEAR), or improved multiple displacement amplification (IMDA). The nucleic acid amplification can be performed for no greater than 1, 2, 3, 4, 5, 6, 7, 8, 9, 10, 11, 12, 13, 14, 15, 16, 17, 18, 19, 20, 25, 30, 40, 50, or 60 minutes. Sometimes, the nucleic acid amplification reaction is performed at a temperature of around 20-45° C. The nucleic acid amplification reaction can be performed at a temperature no greater than 20° C., 25° C., 30° C., 35° C., 37° C., 40° C., 45° C. The nucleic acid amplification reaction can be performed at a temperature of at least 20° C., 25° C., 30° C., 35° C., 37° C., 40° C., or 45° C.

In some embodiments, the target nucleic acid as disclosed herein can activate the programmable nuclease to initiate sequence-independent cleavage of a nucleic acid-based reporter (e.g., a reporter comprising a DNA sequence, a reporter comprising an RNA sequence, or a reporter comprising DNA and RNA). For example, a programmable nuclease of the present disclosure is activated by a target DNA to cleave reporters having an RNA (also referred to herein as an "RNA reporter"). Alternatively, a programmable nuclease of the present disclosure is activated by a target RNA to cleave reporters having an RNA. Alternatively, a programmable nuclease of the present disclosure is activated by a target DNA to cleave reporters having a DNA (also referred to herein as a "DNA reporter"). The RNA reporter can comprise a single-stranded RNA labelled with a detection moiety or can be any RNA reporter as disclosed herein. The DNA reporter can comprise a single-stranded DNA labelled with a detection moiety or can be any DNA reporter as disclosed herein.

In some embodiments, the target nucleic acid as described in the methods herein does not initially comprise a PAM sequence. However, any target nucleic acid of interest may be generated using the methods described herein to comprise a PAM sequence, and thus be a PAM target nucleic acid. A PAM target nucleic acid, as used herein, refers to a target nucleic acid that has been amplified to insert a PAM sequence that is recognized by a CRISPR/Cas system.

Any of the above disclosed samples are consistent with the methods, compositions, reagents, enzymes, and kits disclosed herein and can be used as a companion diagnostic with any of the diseases disclosed herein, or can be used in reagent kits, point-of-care diagnostics, or over-the-counter diagnostics.

Reagents for Detection of Target Nucleic Acids

Disclosed herein are methods of assaying for a target nucleic acid as described herein. The reagents for detection of target nucleic acids, as described herein, are compatible with the DETECTR assay methods disclosed herein. The reagents for detection of target nucleic acids, as described herein, are compatible with any of the programmable nucleases disclosed herein (e.g., a programmable nuclease with at least 60% sequence identity to SEQ ID NO: 11) and use of said programmable nuclease in a method of detecting a target nucleic acid. The reagents for detection of target nucleic acids, as described herein, are compatible with any of the compositions comprising a programmable nuclease and a buffer, which has been developed to improve the function of the programmable nuclease (e.g., a programmable nuclease and a buffer with low salt (about 110 mM or less) and a pH of 7 to 8) and use of said compositions in a method of detecting a target nucleic acid. The reagents for detection of target nucleic acids, as described herein, are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence. A method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample.

The methods of assaying for a target nucleic acid described herein may further comprise introducing a PAM sequence into a target nucleic acid segment that lacks a PAM sequence. For example, a method of assaying for a target nucleic acid segment in a sample, wherein the target nucleic acid segment lacks a PAM sequence, comprises amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample. A PAM-dependent sequence specific nuclease, often, is a programmable nuclease. Sometimes, a PAM-dependent sequence specific nuclease is a PAM-dependent sequence specific endonuclease.

A number of reagents are consistent with the compositions and methods disclosed herein. The reagents described herein for detecting a disease, cancer, or genetic disorder comprise a guide nucleic acid targeting the target nucleic acid segment indicative of a disease, cancer, or genetic disorder. The reagents disclosed herein can include programmable nucleases, guide nucleic acids, target nucleic acids, and buffers. As described herein, target nucleic acid comprising DNA or RNA may be detected (e.g., the target DNA hybridizes to the guide nucleic) using a programmable nuclease and other reagents disclosed herein. As described herein, target nucleic acids comprising DNA may be an amplicon of a nucleic acid of interest and the amplicon can be detected (e.g., the target DNA hybridizes to the guide nucleic) using a programmable nuclease and other reagents disclosed herein. Additionally, detection of multiple target nucleic acids is possible using two or more programmable nucleases complexed to guide nucleic acids that target the multiple target nucleic acids, wherein the programmable nucleases exhibit different sequence-independent cleavage of the nucleic acid of a reporter (e.g., cleavage of an RNA reporter by a first programmable nuclease and cleavage of a DNA reporter by a second programmable nuclease).

Programmable Nucleases

The programmable nucleases disclosed herein (e.g., a type V or VI CRISPR enzyme) enable the detection of target nucleic acids (e.g., DNA or RNA). Additionally, detection by a first programmable nuclease, which can cleave RNA reporters, allows for multiplexing with programmable nucleases, which cleave DNA reporters.

The detection of the target nucleic acid is facilitated by a programmable nuclease. A programmable nuclease can comprise a programmable nuclease capable of being activated when complexed with a guide nucleic acid and target nucleic acid. The programmable nuclease can become activated after binding of a guide nucleic acid to a target nucleic, in which the activated programmable nuclease can cleave the target nucleic acid and exhibits sequence-independent cleavage activity. Sequence-independent cleavage activity, also referred to herein as "trans cleavage activity" or "collateral cleavage activity", can be non-specific cleavage of nearby single-stranded nucleic acids by the activated programmable nuclease, such as trans cleavage of nucleic acids in a reporter, where the reporter also comprises a detection moiety. The reporter may comprise a detector nucleic acid. Once the nucleic acid of the reporter is cleaved by the activated programmable nuclease, the detection moiety is released from the nucleic acid of the reporter, and generates a detectable signal. Often the detection moiety is at least one of a fluorophore, a dye, a polypeptide, or a nucleic acid. Sometimes the detection moiety binds to a capture molecule immobilized on a solid surface. The detectable signal can be visualized on the solid surface to assess the presence, the absence, or level of presence of the target nucleic acid. A detectable signal can be a calorimetric, potentiometric, amperometric, optical (e.g., fluorescent, colorometric, etc.), or piezo-electric signal. Often, the detectable signal is present prior to cleavage of the nucleic acid of the reporter and changes upon cleavage of the nucleic acid of the reporter. Sometimes, the signal is absent prior to cleavage of the nucleic acid of the reporter and is present upon cleavage of the nucleic acid of the reporter. The detectable signal can be immobilized on a solid surface for detection. The programmable nuclease can be a DNA-activated programmable RNA nuclease, a DNA-activated programmable DNA nuclease, or an RNA-activated programmable RNA nuclease. A DNA-activated programmable RNA nuclease is a programmable nuclease, which upon hybridization of its guide nucleic acid to a target DNA, exhibits sequence-independent cleavage of a reporter having a RNA (an RNA reporter). A DNA-activated programmable DNA nuclease is a programmable nuclease, which upon hybridization of its guide nucleic acid to a target DNA, exhibits sequence-independent cleavage of a reporter having a DNA (a DNA reporter). A RNA-activated programmable RNA nuclease is a programmable nuclease, which upon hybridization of its guide nucleic acid to a target RNA, exhibits sequence-independent cleavage of a reporter having a RNA (a RNA reporter). The DNA-activated programmable DNA nuclease can be a Type V CRISPR/Cas enzyme (e.g., Cas12). The DNA-activated programmable RNA nuclease can be a Type VI CRISPR/Cas enzyme (e.g., Cas13). The RNA-activated programmable RNA nuclease can be a Type VI CRISPR/Cas enzyme (e.g., Cas13).

The programmable nucleases disclosed herein may elicit reporter activity upon cleavage of the nucleic acid of the reporter. Reporter activity refers to transcollatoral cleavage activity of a detector nucleic acid. A reporter activity may be a calorimetric, potentiometric, amperometric, optical (e.g., fluorescent, colorometric, etc.), or piezo-electric signal. For example, cleavage of the nucleic acid of the reporter by the programmable nuclease may elicity a fluorescent signal. A reporter activity may increase or decrease over time in response to a programmable nuclease trans cleavage activity. A reporter activity may accumulate over time in response to a programmable nuclease trans cleavage activity. A maximal reporter activity may occur when a reporter signal (e.g., a calorimetric, potentiometric, amperometric, optical (e.g., fluorescent, colorometric, etc.), or piezo-electric signal) is highest within a designated assay. In some embodiments, a maximal reporter signal may occur when a reporter signal reaches a maximum signal, after which the reporter signal decreases. In some embodiments, a maximal reporter signal may occur when a reporter signal increases to saturation after which the signal is no longer increasing.

The programmable nucleases disclosed herein may exhibit cis-cleavage activity or target cleavage activity. Target cleavage activity may refer to the cleavage of a target nucleic acid by the programmable nuclease.

In some embodiments, the Type V CRISPR/Cas enzyme is a programmable Cas12 nuclease. Type V CRISPR/Cas enzymes (e.g., Cas12 or Cas14) lack an HNH domain. A Cas12 nuclease of the present disclosure cleaves a nucleic acid via a single catalytic RuvC domain. This single catalytic RuvC domain includes 3 partial RuvC domains (RuvC-I, RuvC-II, and RuvC-III, also referred to herein as subdomains) that are not contiguous with respect to the primary amino acid sequence of the Cas12 protein, but form an RuvC domain once the protein is produced and folds. In some embodiments, a programmable nuclease comprises three partial RuvC domains. In some embodiments, a programmable nuclease comprises an RuvC-I subdomain, an RuvC-II subdomain, and an RuvC-III subdomain. The RuvC domain is within a nuclease, or "NUC" lobe of the protein, and the Cas12 nucleases further comprise a recognition, or "REC" lobe. The REC and NUC lobes are connected by a bridge helix and the Cas12 proteins additionally include two domains for PAM recognition termed the PAM interacting (PI) domain and the wedge (WED) domain. (Murugan et al., Mol Cell. 2017 Oct. 5; 68(1): 15-25). In some embodiments, a Cas12 protein (e.g., a programmable nuclease having a sequence with at least 60% sequence identity to SEQ ID NO: 11) may recognize a PAM having a sequence of YYN, where N represents any nucleic acid and (e.g., A, T, C, G, or U) Y represents any pyrimidine (e.g., C or T). In some embodiments, a Cas12 protein may recognize a PAM having a sequence of YR, where Y represents any pyrimidine (e.g., C or T) and R represents any purine (e.g., A or G). A programmable Cas12 nuclease can be a Cas12a (also referred to as Cpf1) protein, a Cas12b protein, Cas12c protein, Cas12d protein (also referred to as a CasY protein), or a Cas12e protein. For example, the programmable Cas12 nuclease may be a Cas12a. A programmable Cas12 nuclease can be a Cas12 variant. In some cases, a suitable Cas12 protein comprises an amino acid sequence having at least 50%, at least 55%, at least 60%, at least 65%, at least 70%, at least 75%, at least 80%, at least 85%, at least 90%, at least 92%, at least 95%, at least 98%, at least 99%, or 100%, amino acid sequence identity to any one of the Cas proteins or Cas variants provided in TABLE 1 (e.g., any one of SEQ ID NO: 1-SEQ ID NO: 11, SEQ ID NO: 282, or SEQ ID NO: 571-SEQ ID NO: 602). For example, a suitable Cas12 protein comprises a sequence with at least 60% sequence identity to SEQ ID NO: 11. In some embodiments, a suitable Cas12 protein comprises a sequence with at least 70%, at least 75%, at least 80%, at least 85%, at least 90%, at least 92%, at least 95%, at least 97%, at least 98%, at least 99%, or 100%, amino acid sequence identity to SEQ ID NO: 11. In some embodiments, a suitable Cas12 protein comprises a sequence with at least 70%, at least 75%, at least 80%, at least 85%, at least 90%, at least 92%, at least 95%, at least 97%, at least 98%, at least 99%, or 100%, amino acid sequence identity to SEQ ID NO: 1. For example, a suitable Cas12 protein may comprise an amino acid sequence having at least 50%, at least 55%, at least 60%, at least 65%, at least 70%, at least 75%, at least 80%, at least 85%, at least 90%, at least 92%, at least 95%, at least 97%, at least 98%, at least 99%, or 100%, amino acid sequence identity to SEQ ID NO: 11. A Cas12 protein can have a sequence as set forth in SEQ ID NO: 11. In some embodiments, a Cas12 nuclease may have at least 60%, at least 70%, at least 80%, at least 85%, at least 90%, at least 92%, at least 95%, at least 97%, at least 99%, or 100% sequence identity to any one of SEQ ID NO: 1-SEQ ID NO: 11, SEQ ID NO: 282, or SEQ ID NO: 571-SEQ ID NO: 602.

TABLE 1

Cas12 Sequences

| SEQ ID NO | Description | Sequence |
| --- | --- | --- |
| SEQ ID NO: 1 | Lachnospiraceae bacterium ND2006 (LbCas12a) | MSKLEKFTNCYSLSKTLRFKAIPVGKTQENIDNKRLLVEDEKRAEDYKGV KKLLDRYYLSFINDVLHSIKLKNLNNYISLFRKKTRTEKENKELENLEINLR KEIAKAFKGNEGYKSLFKKDIIETILPEFLDDKDEIALVNSFNGFTTAFTGF FDNRENMFSEEAKSTSIAFRCINENLTRYISNMDIFEKVDAIFDKHEVQEIK |

TABLE 1-continued

Cas12 Sequences

| SEQ ID NO | Description | Sequence |
|---|---|---|
| | | EKILNSDYDVEDFFEGEFFNFVLTQEGIDVYNAIIGGFVTESGEKIKGLNEY<br>INLYNQKTKQKLPKFKPLYKQVLSDRESLSFYGEGYTSDEEVLEVFRNTL<br>NKNSEIFSSIKKLEKLPKNFDEYSSAGIFVKNGPAISTISKDIFGEWNVIRDK<br>WNAEYDDIHLKKKAVVTEKYEDDRRKSFKKIGSFSLEQLQEYADADLSV<br>VEKLKEIIIQKVDEIYKVYGSSEKLFDADFVLEKSLKKNDAVVAIMKDLLD<br>SVKSFENYIKAFFGEGKETNRDESFYGDFVLAYDILLKVDHIYDAIRNYVT<br>QKPYSKDKFKLYFQNPQFMGGWDKDKETDYRATILRYGSKYYLAIMDK<br>KYAKCLQKIDKDDVNGNYEKINYKLLPGPNKMLPKVFFSKKWMAYYNP<br>SEDIQKIYKNGTFKKGDMFNLNDCHKLIDFFKDSISRYPKWSNAYDFNFSE<br>TEKYKDIAGFYREVEEQGYKVSFESASKKEVDKLVEEGKLYMFQIYNKD<br>FSDKSHGTPNLHTMYFKLLFDENNHGQIRLSGGAELFMRRASLKKEELVV<br>HPANSPIANKNPDNPKKTTTLSYDVYKDKRFSEDQYELHIPIAINKCPKNIF<br>KINTEVRVLLKHDDNPYVIGIDRGERNLLYIVVVDGKGNIVEQYSLNEIIN<br>NFNGIRIKTDYHSLLDKKEKERFEARQNWTSIENIKELKAGYISQVVHKIC<br>ELVEKYDAVIALEDLNSGFKNSRVKVEKQVYQKFEKMLIDKLNYMVDK<br>KSNPCATGGALKGYQITNKFESFKSMSTQNGFIFYIPAWLTSKIDPSTGFV<br>NLLKTKYTSIADSKKFISSFDRIMYVPEEDLFEFALDYKNFSRTDADYIKK<br>WKLYSYGNRIRIFRNPKKNNVFDWEEVCLTSAYKELFNKYGINYQQGDIR<br>ALLCEQSDKAFYSSFMALMSLMLQMRNSITGRTDVDFLISPVKNSDGIFY<br>DSRNYEAQENAILPKNADANGAYNIARKVLWAIGQFKKAEDEKLDKVKI<br>AISNKEWLEYAQTSVKH |
| SEQ ID NO: 2 | *Acidaminococcus sp.* BV316 (AsCas12a) | MTQFEGFTNLYQVSKTLRFELIPQGKTLKHIQEQGFIEEDKARNDHYKELK<br>PIIDRIYKTYADQCLQLVQLDWENLSAAIDSYRKEKTEETRNALIEEQATY<br>RNAIHDYFIGRTDNLTDAINKRHAEIYKGLFKAELFNGKVLKQLGTVTTTE<br>HENALLRSFDKFTTYFSGFYENRKNVFSAEDISTAIPHRIVQDNFPKFKENC<br>HIFTRLITAVPSLREHFENVKKAIGIFVSTSIEEVFSFPPFYNQLLTQTQIDLYN<br>QLLGGISREAGTEKIKGLNEVLNLAIQKNDETAHIIASLPHRFIPLFKQILSD<br>RNTLSFILEEFKSDEEVIQSFCKYKTLLRNENVLETAEALFNELNSIDLTHIF<br>ISHKKLETISSALCDHWDTLRNALYERRISELTGKITKSAKEKVQRSLKHE<br>DINLQEIISAAGKELSEAFKQKTSEILSHAHAALDQPLPTTLKKQEEKEILK<br>SQLDSLLGLYHLLDWFAVDESNEVDPEFSARLTGIKLEMEPSLSFYNKAR<br>NYATKKPYSVEKFKLNFQMPTLASGWDVNKEKNNGAILFVKNGLYYLGI<br>MPKQKGRYKALSFEPTEKTSEGFDKMYYDYFPDAAKMIPKCSTQLKAVT<br>AHFQTHTTPILLSNNFIEPLEITKEIYDLNNPEKEPKKFQTAYAKKTGDQKG<br>YREALCKWIDFTRDFLSKYTKTTSIDLSSLRPSSQYKDLGEYYAELNPLLY<br>HISFQRIAEKEIMDAVETGKLYLFQIYNKDFAKGHHGKPNLHTLYWTGLF<br>SPENLAKTSIKLNGQAELFYRPKSRMKRMAHRLGEKMLNKKLKDQKTPI<br>PDTLYQELYDYVNHRLSHDLSDEARALLPNVITKEVSHEIIKDRRFTSDKF<br>FFHVPITLNYQAANSPSKFNQRVNAYLKEHPETPIIGIDRGERNLIYITVIDS<br>TGKILEQRSLNTIQQFDYQKKLDNREKERVAARQAWSVVGTIKDLKQGY<br>LSQVIHEIVDLMIHYQAVVVLENLNFGFKSKRTGIAEKAVYQQFEKMLID<br>KLNCLVLKDYPAEKVGGVLNPYQLTDQFTSFAKMGTQSGFLFYVPAPYT<br>SKIDPLTGFVDPFVWKTIKNHESRKHFLEGFDFLHYDVKTGDFILHFKMN<br>RNLSFQRGLPGFMPAWDIVFEKNETQFDAKGTPFIAGKRIVPVIENHRFTG<br>RYRDLYPANELIALLEEKGIVFRDGSNILPKLLENDDSHAIDTMVALIRSVL<br>QMRNSNAATGEDYINSPVRDLNGVCFDSRFQNPEWPMDADANGAYHIA<br>LKGQLLLNHLKESKDLKLQNGISNQDWLAYIQELRN |
| SEQ ID NO: 3 | *Francisella novicida* U112 (FnCas12a) | MSIYQEFVNKYSLSKTLRFELIPQGKTLENIKARGLILDDEKRAKDYKKAK<br>QIIDKYHQFFIEEILSSVCISEDLLQNYSDVYFKLKKSDDDNLQKDFKSAKD<br>TIKKQISEYIKDSEKFKNLFNQNLIDAKKGQESDLILWLKQSKDNGIELFKA<br>NSDITDIDEALEIIKSFKGWTTYFKGFHENRKNVYSSNDIPTSIIYRIVDDNL<br>PKFLENKAKYESLKDKAPEAINYEQIKKDLAEELTFDIDYKTSEVNQRVFS<br>LDEVFEIANFNNYLNQSGITKFNTIIGGKFVNGENTKRKGINEYINLYSQQI<br>NDKTLKKYKMSVLFKQILSDTESKSFVIDKLEDDSDVVTTMQSFYEQIAA<br>FKTVEEKSIKETLSLLFDDLKAQKLDLSKIYFKNDKSLTDLSQQVFDDYSV<br>IGTAVLEYITQQIAPKNLDNPSKKEQELIAKKTEKAKYLSLETIKLALEEFN<br>KHRDIDKQCRFEEILANFAAIPMIFDEIAQNKDNLAQISIKYQNQGKKDLL<br>QASAEDDVKAIKDLLDQTNNLLHKLKIFHISQSEDKANILDKDEHFYLVFE<br>ECYFELANIVPLYNKIRNYITQKPYSDEKFKLNFENSTLANGWDKNKEPD<br>NTAILFIKDDKYYLGVMNKKNNKIFDDKAIKENKGEGYKKIVYKLLPGAN<br>KMLPKVFFSAKSIKFYNPSEDILRIRNHSTHTKNGSPQKGYEKFEFNIEDCR<br>KFIDFYKQSISKHPEWKDFGFRFSDTQRYNSIDEFYREVENQGYKLTFENIS<br>ESYIDSVVNQGKLYLFQIYNKDFSAYSKGRPNLHTLYWKALFDERNLQD<br>VVYKLNGEAELFYRKQSIPKKITHPAKEAIANKNKDNPKKESVFEYDLIK<br>DKRFTEDKFFFHCPITINPKSSGANKFNDEINLLLKEKANDVHILSIDRGER<br>HLAYYTLVDGKGNIIKQDTFNIIGNDRMKTNYHDKLAAIEKDRDSARKD<br>WKKINNIKEMKEGYLSQVVHEIAKLVIEYNAIVVFEDLNFGFKRGRFKVE<br>KQVYQKLEKMLIEKLNYLVFKDNEFDKTGGVLRAYQLTAPFETFKKMGK |

TABLE 1-continued

Cas12 Sequences

| SEQ ID NO | Description | Sequence |
|---|---|---|
| | | QTGITYYVPAGFTSKICPVTGFVNQLYPKYESVSKSQEFFSKFDKICYNLDK<br>GYFEFSFDYKNFGDKAAKGKWTIASFGSRLINFRNSDKNHNWDTREVYP<br>TKELEKLLKDYSIEYGHGECIKAAICGESDKKFFAKLTSVLNTILQMRNSK<br>TGTELDYLISPVADVNGNFFDSRQAPKNMPQDADANGAYHIGLKGLMLL<br>GRIKNNQEGKKLNLVIKNEEYFEFVQNRNN |
| SEQ ID NO: 4 | Porphyromonas macacae (PmCas12a) | MKTQHFFEDFTSLYSLSKTIRFELKPIGKTLENIKKNGLIRRDEQRLDDYEK<br>LKKVIDEYHEDFIANILSSFSFSEEILQSYIQNLSESEARAKIEKTMRDTLAK<br>AFSEDERYKSIFKKELVKKDIPVWCPAYKSLCKKFDNFTTSLVPFHENRK<br>NLYTSNEITASIPYRIVHVNLPKFIQNIEALCELQKKMGADLYLEMMENLR<br>NVWPSFVKTPDDLCNLKTYNHLMVQSSISEYNRFVGGYSTEDGTKHQGI<br>NEWINIYRQRNKEMRLPGLVFLHKQILAKVDSSSFISDTLENDDQVFCVLR<br>QFRKLFWNTVSSKEDDAASLKDLFCGLSGYDPEAIYVSDAHLATISKNIFD<br>RWNYISDAIRRKTEVLMPRKKESVERYAEKISKQIKKRQSYSLAELDDLL<br>AHYSEESLPAGFSLLSYFTSLGGQKYLVSDGEVILYEEGSNIWDEVLIAFR<br>DLQVILDKDFTEKKLGKDEEAVSVIKKALDSALRLRKFFDLLSGTGAEIRR<br>DSSFYALYTDRMDKLKGLLKMYDKVRNYLTKKPYSIEKFKLHFDNPSLL<br>SGWDKNKELNNLSVIFRQNGYYYLGIMTPKGKNLFKTLPKLGAEEMFYE<br>KMEYKQIAEPMLMLPKVFFPKKTKPAFAPDQSVVDIYNKKTFKTGQKGF<br>NKKDLYRLIDFYKEALTVHEWKLFNFSFSPTEQYRNIGEFFDEVREQAYK<br>VSMVNVPASYIDEAVENGKLYLFQIYNKDFSPYSKGIPNLHTLYWKALFS<br>EQNQSRVYKLCGGGELFYRKASLHMQDTTVHPKGISIHKKNLNKKGETS<br>LFNYDLVKDKRFTEDKFFFHVPISINYKNKKITNVNQMVRDYIAQNDDLQ<br>IIGIDRGERNLLYISRIDTRGNLLEQFSLNVIESDKGDLRTDYQKILGDREQE<br>RLRRRQEWKSIESIKDLKDGYMSQVVHKICNMVVEHKAIVVLENLNLSF<br>MKGRKKVEKSVYEKFERMLVDKLNYLVVDKKNLSNEPGGLYAAYQLTN<br>PLFSFEELHRYPQSGILFFVDPWNTSLTDPSTGFVNLLGRINYTNVGDARK<br>FFDRFNAIRYDGKGNILFDLDLSRFDVRVETQRKLWTLTTFGSRIAKSKKS<br>GKWMVERIENLSLCFLELFEQFNIGYRVEKDLKKAILSQDRKEFYVRLIYL<br>FNLMMQIRNSDGEEDYILSPALNEKNLQFDSRLIEAKDLPVDADANGAYN<br>VARKGLMVVQRIKRGDHESIHRIGRAQWLRYVQEGIVE |
| SEQ ID NO: 5 | Moraxella bovoculi 237 (MbCas12a) | MLFQDFTHLYPLSKTVRFELKPIDRTLEHIHAKNFLSQDETMADMHQKVK<br>VILDDYHRDFIADMMGEVKLTKLAEFYDVYLKFRKNPKDDELQKQLKDL<br>QAVLRKEIVKPIGNGGKYKAGYDRLFGAKLFKDGKELGDLAKFVIAQEG<br>ESSPKLAHLAHFEKFSTYFTGFHDNRKNMYSDEDKHTAIAYRLIHENLPRF<br>IDNLQILTTIKQKHSALYDQIINELTASGLDVSLASHLDGYHKLLTQEGITA<br>YNTLLGGISGEAGSPKIQGINELINSHHNQHCHKSERIAKLRPLHKQILSDG<br>MSVSFLPSKFADDSEMCQAVNEFYRHYADVFAKVQSLFDGFDDHQKDGI<br>YVEHKNLNELSKQAFGDFALLGRVLDGYYVDVVNPEFNERFAKAKTDN<br>AKAKLTKEKDKFIKGVHSLASLEQAIEHYTARHDDESVQAGKLGQYFKH<br>GLAGVDNPIQKIHNNHSTIKGFLERERPAGERALPKIKSGKNPEMTQLRQL<br>KELLDNALNVAHFAKLLTTKTTLDNQDGNFYGEFGVLYDELAKIPTLYN<br>KVRDYLSQKPFSTEKYKLNFGNPTLLNGWDLNKEKDNFGVILQKDGCYY<br>LALLDKAHKKVFDNAPNTGKSIYQKMIYKYLEVRKQFPKVFFSKEAIAIN<br>YHPSKELVEIKDKGRQRSDDERLKLYRFILECLKIHPKYDKKFEGAIGDIQ<br>LFKKDKKGREVPISEKDLFDKINGIFSSKPKLEMEDFFIGEFKRYNPSQDLV<br>DQYNIYKKIDSNDNRKKENFYNNHPKFKKDLVRYYYESMCKHEEWEESF<br>EFSKKLQDIGCYVDVNELFTEIETRRLNYKISFCNINADYIDELVEQGQLYL<br>FQIYNKDFSPKAHGKPNLHTLYFKALFSEDNLADPIYKLNGEAQIFYRKAS<br>LDMNETTIHRAGEVLENKNPDNPKKRQFVYDIIKDKRYTQDKFMLHVPIT<br>MNFGVQGMTIKEKNKKVNQSIQQYDEVNVIGIDRGERHLLYLTVINSKGEI<br>LEQCSLNDITTASANGTQMTTPYHKILDKREIERLNARVGWGEIETIKELK<br>SGYLSHVVHQISQLMLKYNAIVVLEDLNFGFKRGRFKVEKQIYQNFENAL<br>IKKLNHLVLKDKADDEIGSYKNALQLTNNFTDLKSIGKQTGFLFYVPAWN<br>TSKIDPETGFVDLLKPRYENIAQSQAFFGKFDKICYNADKDYFEFHIDYAK<br>FTDKAKNSRQIWTICSHGDKRYVYDKTANQNKGAAKGINVNDELKSLFA<br>RHHINEKQPNLVMDICQNNDKEFHKSLMYLLKTLLALRYSNASSDEDFIL<br>SPVANDEGVFFNSALADDTQPQNADANGAYHIALKGLWLLNELKNSDDL<br>NKVKLAIDNQTWLNFAQNR |
| SEQ ID NO: 6 | Moraxella bovoculi AAX08_00205 (Mb2Cas12a) | MGIHGVPAALFQDFTHLYPLSKTVRFELKPIGRTLEHIHAKNFLSQDETMA<br>DMYQKVKVILDDYHRDFIADMMGEVKLTKLAEFYDVYLKFRKNPKDDG<br>LQKQLKDLQAVLRKESVKPIGSGGKYKTGYDRLFGAKLFKDGKELGDLA<br>KFVIAQEGESSPKLAHLAHFEKFSTYFTGFHDNRKNMYSDEDKHTAIAYR<br>LIHENLPRFIDNLQILTTIKQKHSALYDQIINELTASGLDVSLASHLDGYHK<br>LLTQEGITAYNRIIGEVNGYTNKHNQICHKSERIAKLRPLHKQILSDGMGV<br>SFLPSKFADDSEMCQAVNEFYRHYTDVFAKVQSLFDGFDDHQKDGIYVE<br>HKNLNELSKQAFGDFALLGRVLDGYYVDVVNPEFNERFAKAKTDNAKA<br>KLTKEKDKFIKGVHSLASLEQAIEHHTARHDDESVQAGKLGQYFKHGLA<br>GVDNPIQKIHNNHSTIKGFLERERPAGERALPKIKSGKNPEMTQLRQLKEL<br>LDNALNVAHFAKLLTTKTTLDNQDGNFYGEFGVLYDELAKIPTLYNKVR<br>DYLSQKPFSTEKYKLNFGNPTLLNGWDLNKEKDNFGVILQKDGCYYLAL<br>LDKAHKKVFDNAPNTGKNVYQKMVYKLLPGPNKMLPKVFFAKSNLDYY |

TABLE 1-continued

Cas12 Sequences

| SEQ ID NO | Description | Sequence |
|---|---|---|
| | | NPSAELLDKYAKGTHKKGDNFNLKDCHALIDFFKAGINKHPEWQHFGFK FSPTSSYRDLSDFYREVEPQGYQVKFVDINADYIDELVEQGKLYLFQIYNK DFSPKAHGKPNLHTLYFKALFSEDNLADPIYKLNGEAQIFYRKASLDMNE TTIHRAGEVLENKNPDNPKKRQFVYDIIKDKRYTQDKFMLHVPITMNFGV QGMTIKEFNKKVNQSIQQYDEVNVIGIDRGERHLLYLTVINSKGEILEQRS LNDITTASANGTQVTTPYHKILDKREIERLNARVGWGEIETIKELKSGYLS HVVHQINQLMLKYNAIVVLEDLNFGFKRGRFKVEKQIYQNFENALIKKLN HLVLKDKADDEIGSYKNALQLTNNFTDLKSIGKQTGFLFYVPAWNTSKID PETGFVDLLKPRYENIAQSQAFFGKFDKICYNTDKGYFEFHIDYAKFTDKA KNSRQKWAICSHGDKRYVYDKTANQNKGAAKGINVNDELKSLFARYHI NDKQPNLVMDICQNNDKEFHKSLMCLLKTLLALRYSNASSDEDFILSPVA NDEGVFFNSALADDTQPQNADANGAYHIALKGLWLLNELKNSDDLNKV KLAIDNQTWLNFAQNR |
| SEQ ID NO: 7 | Moraxella bovoculi AAX11_00205 (Mb3Cas12a) | MGIHGVPAALFQDFTHLYPLSKTVRFELKPIGKTLEHIHAKNFLNQDETM ADMYQKVKAILDDYHRDFIADMMGEVKLTKLAEFYDVYLKFRKNPKDD GLQKQLKDLQAVLRKEIVKPIGNGGKYKAGYDRLFGAKLFKDGKELGDL AKFVIAQEGESSPKLAHLAHFEKFSTYFTGFHDNRKNMYSDEDKHTAIAY RLIHENLPRFIDNLQILATIKQKHSALYDQIINELTASGLDVSLASHLDGYH KLLTQEGITAYNTLLGGISGEAGSRKIQGINELINSHHNQHCHKSERIAKLR PLHKQILSDGMGVSFLPSKFADDSEVCQAVNEFYRHYADVFAKVQSLFD GFDDYQKDGIYVEYKNLNELSKQAFGDFALLGRVLDGYYVDVVNPEFNE RFAKAKTDNAKAKLTKEKDKFIKGVHSLASLEQAIEHYTARHDDESVQA GKLGQYFKHGLAGVDNPIQKIHNNHSTIKGFLERERPAGERALPKIKSDKS PEIRQLKELLDNALNVAHFAKLLTTKTTLHNQDGNFYGEFGALYDELAKI ATLYNKVRDYLSQKPFSTEKYKLNFGNPTLLNGWDLNKEKDNFGVILQK DGCYYLALLDKAHKKVFDNAPNTGKSVYQKMIYKLLPGPNKMLPKVFF AKSNLDYYNPSAELLDKYAQGTHKKGDNFNLKDCHALIDFFKAGINKHP EWQHFGFKFSPTSSYQDLSDFYREVEPQGYQVKFVDINADYINELVEQGQ LYLFQIYNKDFSPKAHGKPNLHTLYFKALFSEDNLVNPIYKLNGEAEIFYR KASLDMNETTIHRAGEVLENKNPDNPKKRQFVYDIIKDKRYTQDKFMLH VPITMNFGVQGMTIKEFNKKVNQSIQQYDEVNVIGIDRGERHLLYLTVINS KGEILEQRSLNDITTASANGTQMTTPYHKILDKREIERLNARVGWGEIETI KELKSGYLSHVVHQISQLMLKYNAIVVLEDLNFGFKRGRFKVEKQIYQNF ENALIKKLNHLVLKDKADDEIGSYKNALQLTNNFTDLKSIGKQTGFLFYV PAWNTSKIDPETGFVDLLKPRYENIAQSQAFFGKFDKICYNADRGYFEFHI DYAKFNDKAKNSRQIWKICSHGDKRYVYDKTANQNKGATIGVNVNDEL KSLFTRYHINDKQPNLVMDICQNNDKEFHKSLMYLLKTLLALRYSNASSD EDFILSPVANDEGVFFNSALADDTQPQNADANGAYHIALKGLWLLNELK NSDDLNKVKLAIDNQTWLNFAQNR |
| SEQ ID NO: 8 | Thiomicrospira sp. XS5 (TsCas12a) | MGIHGVPAATKTFDSEFFNLYSLQKTVRFELKPVGETASFVEDFKNEGLK RVVSEDERRAVDYQKVKEIIDDYHRDFIEESLNYFPEQVSKDALEQAFHL YQKLKAAKVEEREKALKEWEALQKKLREKVVKCFSDSNKARFSRIDKKE LIKEDLINWLVAQNREDDIPTVETFNNFTYFTGFHENRKNIYSKDDHATA ISFRLIHENLPKFFDNVISFNKLKEGFPELKFDKVKEDLEVDYDLKHAFEIE YFVNFVTQAGIDQYNYLLGGKTLEDGTKKQGMNEQINLFKQQQTRDKAR QIPKLIPLFKQILSERTESQSFIPKQFESDQELFDSLQKLHNNCQDKFTVLQQ AILGLAEADLKKVFIKTSDLNALSNTIFGNYSVFSDALNLYKESLKTKKAQ EAFEKLPAHSIHDLIQYLEQFNSSLDAEKQQSTDTVLNYFIKTDELYSRFIK STSEAFTQVQPLFELEALSSKRRPPESEDEGAKGQEGFEQIKRIKAYLDTL MEAVHFAKPLYLVKGRKMIEGLDKDQSFYEAFEMAYQELESLIIPIYNKA RSYLSRKPFKADKFKINFDNNTLLSGWDANKETANASILFKKDGLYYLGI MPKGKTFLFDYFVSSEDSEKLKQRRQKTAEEALAQDGESYFEKIRYKLLP GASKMLPKVFFSNKNIGFYNPSDDILRIRNTASHTKNGTPQKGHSKVEFNL NDCHKMIDFFKSSIQKHPEWGSFGFTFSDTSDFEDMSAFYREVENQGYVIS FDKIKETYIQSQVEQGNLYLFQIYNKDFSPYSKGKPNLHTLYWKALFEEA NLNNVVAKLNGEAEIFFRRHSIKASDKVVHPANQAIDNKNPHTEKTQSTF EYDLVKDKRYTQDKFFFHVPISLNFKAQGVSKFNDKVNGFLKGNPDVNII GIDRGERHLLYFTVVNQKGEILVQESLNTLMSDKGHVNDYQQKLDKKEQ ERDAARKSWTTVENIKELKEGYLSHVVHKLAHLIIKYNAIVCLEDLNFGF KRGRFKVEKQVYQKFEKALIDKLNYLVFKEKELGEVGHYLTAYQLTAPF ESFKKLGKQSGILFYVPADYTSKIDPTTGFVNFLDLRYQSVEKAKQLLSDF NAIRFNSVQNYFEFEIDYKKLTPKRKVGTQSKWVICTYGDVRYQNRRNQ KGHWETEEVNVTEKLKALFASDSKTTTVIDYANDDNLIDVILEQDKASFF KELLWLLKLTMTLRHSKIKSEDDFILSPVKNEQGEFYDSRKAGEVWPKDA DANGAYHIALKGLWLQQQINQWEKGKTLNLAIKNQDWFSFIQEKPYQE |
| SEQ ID NO: 9 | Butyrivibrio sp. NC3005 (BsCas12a) | MGIHGVPAAYYQNLTKKYPVSKTIRNELIPIGKTLENIRKNNILESDVKRK QDYEHVKGIMDEYHKQLINEALDNYMLPSLNQAAEIYLKKHVDVEDREE FKKTQDLLRREVTGRLKEHENYTKIGKKDILDLLEKLPSISEEDYNALESF RNFYTYFTSYNKVRENLYSDEEKSSTVAYRLINENLPKFLDNIKSYAFVKA AGVLADCIEEEEQDALFMVETFNMTLTQEGIDMYNYQIGKVNSAINLYNQ KNHKVEEFKKIPKMKVLYKQILSDREEVFIGEFKDDETLLSSIGAYGNVL |

TABLE 1-continued

Cas12 Sequences

| SEQ ID NO | Description | Sequence |
|---|---|---|
| | | MTYLKSEKINIFFDALRESEGKNVYVKNDLSKTTMSNIVFGSWSAFDELL<br>NQEYDLANENKKKDDKYFEKRQKELKKNKSYTLEQMSNLSKEDISPIEN<br>YIERISEDIEKICIYNGEFEKIVVNEHDSSRKLSKNIKAVKVIKDYLDSIKEL<br>EHDIKLINGSGQELEKNLVVYVGQEEALEQLRPVDSLYNLTRNYLTKKPF<br>STEKVKLNFNKSTLLNGWDKNKETDNLGILFFKDGKYYLGIMNTTANKA<br>FVNPPAAKTENVFKKVDYKLLPGSNKMLPKVFFAKSNIGYYNPSTELYSN<br>YKKGTHKKGPSFSIDDCHNLIDFFKESIKKHEDWSKFGFEFSDTADYRDIS<br>EFYREVEKQGYKLTFTDIDESYINDLIEKNELYLFQIYNKDFSEYSKGKLN<br>LHTLYFMMLFDQRNLDNVVYKLNGEAEVFYRPASIAENELVIHKAGEGIK<br>NKNPNRAKVKETSTFSYDIVKDKRYSKYKFTLHIPITMNFGVDEVRRFND<br>VINNALRTDDNVNVIGIDRGERNLLYVVVINSEGKILEQISLNSIINKEYDIE<br>TNYHALLDEREDDRNKARKDWNTIENIKELKTGYLSQVVNVVAKLVLKY<br>NAIICLEDLNFGFKRGRQKVEKQVYQKFEKMLIEKLNYLVIDKSREQVSPE<br>KMGGALNALQLTSKFKSFAELGKQSGITYYVPAYLTSKIDPTTGFVNLFYI<br>KYENIEKAKQFFDGFDFIRFNKKDDMFEFSFDYKSFTQKACGIRSKWIVYT<br>NGERIIKYPNPEKNNLFDEKVINVTDEIKGLFKQYRIPYENGEDIKEIIISKA<br>EADFYKRLFRLLHQTLQMRNSTSDGTRDYIISPVKNDRGEFFCSEFSEGTM<br>PKDADANGAYNIARKGLWVLEQIRQKDEGEKVNLSMTNAEWLKYAQLH<br>LL |
| SEQ ID NO: 10 | AacCas12b | MAVKSIKVKLRLDDMPEIRAGLWKLHKEVNAGVRYYTEWLSLLRQENL<br>YRRSPNGDGEQECDKTAEECKAELLERLRARQVENGHRGPAGSDDELLQ<br>LARQLYELLVPQAIGAKGDAQQIARKFLSPLADKDAVGGLGIAKAGNKP<br>RWVRMREAGEPGWEEEKEKAETRKSADRTADVLRALADFGLKPLMRVY<br>TDSEMSSVEWKPLRKGQAVRTWDRDMFQQAIERMMSWESWNQRVGQE<br>YAKLVEQKNRFEQKNFVGQEHLVHLVNQLQQDMKEASPGLESKEQTAH<br>YVTGRALRGSDKVFEKWGKLAPDAPFDLYDAEIKNVQRRNTRRFGSHDL<br>FAKLAEPEYQALWREDASFLTRYAVYNSILRKLNHAKMFATFTLPDATA<br>HPIWTRFDKLGGNLHQYTFLFNEFGERRHAIRFHKLLKVENGVAREVDD<br>VTVPISMSEQLDNLLPRDPNEPIALYFRDYGAEQHFTGEFGGAKIQCRRDQ<br>LAHMHRRRGARDVYLNVSVRVQSQSEARGERRPPYAAVFRLVGDNHRA<br>FVHFDKLSDYLAEHPDDGKLGSEGLLSGLRVMSVDLGLRTSASISVFRVA<br>RKDELKPNSKGRVPFFFPIKGNDNLVAVHERSQLLKLPGETESKDLRAIRE<br>ERQRTLRQLRTQLAYLRLLVRCGSEDVGRRERSWAKLIEQPVDAANHMT<br>PDWREAFENELQKLKSLHGICSDKEWMDAVYESVRRVWRHMGKQVRD<br>WRKDVRSGERPKIRGYAKDVVGGNSIEQIEYLERQYKFLKSWSFFGKVSG<br>QVIRAEKGSRFAITLREHIDHAKEDRLKKLADRIIMEALGYVYALDERGK<br>GKWVAKYPPCQLILLEELSEYQFNNDRPPSENNQLMQWSHRGVFQELIN<br>QAQVHDLLVGTMYAAFSSRFDARTGAPGIRCRRVPARCTQEHNPEPFPW<br>WLNKFVVEHTLDACPLRADDLIPTGEGEIFVSPFSAEEGDFHQIHADLNAA<br>QNLQQRLWSDFDISQIRLRCDWGEVDGELVLIPRLTGKRTADSYSNKVFY<br>TNTGVTYYERERGKKRRKVFAQEKLSEEEAELLVEADEAREKSVVLMRD<br>PSGIINRGNWTRQKEFWSMVNQRIEGYLVKQIRSRVPLQDSACENTGDI |
| SEQ ID NO: 11 | Cas12 Variant | MKKIDNFVGCYPVSKTLRFKAIPIGKTQENIEKKRLVEEDEVRAKDYKAV<br>KKLIDRYHREFIEGVLDNVKLDGLEEYYMLFNKSDREESDNKKIEIMEERF<br>RRVISKSFKNNEEYKKIFSKKIIEEILPNYIKDEEEKELVKGFKGFYTAFVG<br>YAQNRENMYSDEKKSTAISYRIVNENMPRFITNIKVFEKAKSILDVDKINEI<br>NEYILNNDYYVDDFFNIDFFNYVLNQKGIDIYNAIIGGIVTGDGRKIQGLNE<br>CINLYNQENKKIRLPQFKPLYKQILSESESMSFYIDEIESDDMLIDMLKESL<br>QIDSTINNAIDDLKVLFNNIFDYDLSGIFINNGLPITTISNDVYGQWSTISDG<br>WNERYDVLSNAKDKESEKYFEKRRKEYKKVKSFSISDLQELGGKDLSICK<br>KINEIISEMIDDYKSKIEEEIQYLFDIKELEKPLVTDLNKIELIKNSLDGLKRIE<br>RYVIPFLGTGKEQNRDEVFYGYFIKCIDAIKEIDGVYNKTRNYLTKKPYSK<br>DKFKLYFENPQLMGGWDRNKESDYRSTLLRKNGKYYVAIIDKSSSNCMM<br>NIEEDENDNYEKINYKLLPGPNKMLPKVFFSKKNREYFAPSKEIERIYSTG<br>TFKKDTNFVKKDCENLITFYKDSLDRHEDWSKSFDFSFKESSAYRDISEFY<br>RDVEKQGYRVSFDLLSSNAVNTLVEEGKLYLFQLYNKDFSEKSHGIPNLH<br>TMYFRSLFDDNNKGNIRLNGGAEMFMRRASLNKQDVTVHKANQPIKNK<br>NLLNPKKTTTLPYDVYKDKRFTEDQYEVHIPITMNKVPNNPYKINHMVRE<br>QLVKDDNPYVIGIDRGERNLIYVVVVDGQGHIVEQLSLNEIINENNGISIRT<br>DYHTLLDAKERERDESRKQWKQIENIKELKEGYISQVVHKICELVEKYDA<br>VIALEDLNSGFKNSRVKVEKQVYQKFEKMLITKLNYMVDKKKDYNKPG<br>GVLNGYQLTTQFESFSKMGTQNGIMFYIPAWLTSKMDPTTGFVDLLKPK<br>YKNKADAQKFFSQFDSIRYDNQEDAFVFKVNYTKFPRTDADYNKEWEIY<br>TNGERIRVFRNPKKNNEYDYETVNVSERMKELFDSYDLLYDKGELKETIC<br>EMEESKFFEELIKLFRLTLQMRNSISGRTDVDYLISPVKNSNGYFYNSNDY<br>KKEGAKYPKDADANGAYNIARKVLWAIEQFKMADEDKLDKTKISIKNQE<br>WLEYAQTHCE |
| SEQ ID NO: 282 | CasY3 | MKAKKSFYNQKRKFGKRGYRLHDERIAYSGGIGSMRSIKYELKDSYGIAG<br>LRNRIADATISDNKWLYGNINLNDYLEWRSSKTDKQIEDGDRESSLLGFW<br>LEALRLGFVFSKQSHAPNDFNETALQDLFETLDDDLKHVLDRKKWCDFIK<br>IGTPKTNDQGRLKKQIKNLLKGNKREEIEKTLNESDDELKEKINRIADVFA |

TABLE 1-continued

Cas12 Sequences

| SEQ ID NO | Description | Sequence |
|---|---|---|
| | | KNKSDKYTIFKLDKPNTEKYPRINDVQVAFFCHPDFEEITERDRTKTLDLII NRFNKRYEITENKKDDKTSNRMALYSLNQGYIPRVLNDLFLFVKDNEDDF SQFLSDLENFFSFSNEQIKIKIIKERLKKLKKYAEPIPGKPQLADKWDDYASDF GGKLESWYSNRIEKLKKIPESVSDLRNNLEKIRNVLKKQNNASKILELSQK IIEYIRDYGVSFEKPEIIKFSWINKTKDGQKKVFYVAKMADREFIEKLDLW MADLRSQLNEYNQDNKVSFKKKGKKIEELGVLDFALNKAKKNKSTKNE NGWQQKLSESIQSAPLFFGEGNRVRNEEVYNLKDLLFSEIKNVENILMSSE AEDLKNIKIEYKEDGAKKGNYVLNVLARFYARFNEDGYGGWNKVKTVL ENIAREAGTDFSKYGNNNNRNAGRFYLNGRERQVFTLIKFEKSITVEKILE LVKLPSLLDEAYRDLVNENKNHKLRDVIQLSKTIMALVLSHSDKEKQIGG NYIHSKLSGYNALISKRDFISRYSVQTTNGTQCKLAIGKGKSKKGNEIDRY FYAFQFFKNDDSKINLKVIKNNSHKNIDFNDNENKINALQVYSSNYQIQFL DWFFEKHQGKKTSLEVGGSFTIAEKSLTIDWSGSNPRVGFKRSDTEEKRV FVSQPFTLIPDDEDKERRKERMIKTKNRFIGIDIGEYGLAWSLIEVDNGDK NNRGIRQLESGFITDNQQQVLKKNVKSWRQNQIRQTFTSPDTKIARLRESL IGSYKNQLESLMVAKKANLSFEYEVSGFEVGGKRVAKIYDSIKRGSVRKK DNNSQNDQSWGKKGINEWSFETTAAGTSQFCTHCKRWSSLAIVDIEEYEL KDYNDNLFKVKINDGEVRLLGKKGWRSGEKIKGKELFGPVKDAMRPNV DGLGMKIVKRKYLKLDLRDWVSRYGNMAIFICPYVDCHHISHADKQAAF NIAVRGYLKSVNPDRAIKHGDKGLSRDFLCQEEGKLNFEQIGLLI |
| SEQ ID NO: 571 | Cas12 variant | MATLVSFTKQYQVQKTLRFELIPQGKTQANIDAKGFINDDLKRDENYMK VKGVIDELHKNFIEQTLVNVDYDWRSLATAIKNYRKDRSDTNKKNLEKT QEAARKEIIAWFEGKRGNSAFKNNQKSFYGKLFKKELFSEILRSDDLEYDE ETQDAIACFDKFTTYFVGFHENRKNMYSTEAKSTSVAYRVVNENFSKFLS NCEAFSVLEAVCPNVLVEAEQELHLHKAFSDLKLSDVFKVEAYNKYLSQ TGIDYYNQIIGGISSAEGVRKIRGVNEVVNNAIQQNDELKVALRNKQFTM VQLFKQILSDRSTLSFVSEQFTSDQEVITVVKQFNDDIVNNKVLAVVKTLF ENFNSYDLEKIYINSKELASVSNALLKDWSKIRNAVLENKIIELGANPPKT KISAVEKEVKNKDFSIAELASYNDKYLDKEGNDKEICSIANVVLEAVGAL EIMLAESLPADLKTLENKNKVKGILDAYENLLHLLNYFKVSAVNDVDLAF YGAFEKVYVDISGVMPLYNKVRNYATKKPYSVEKFKLNFAMPTLADGW DKNKERDNGSIILLKDGQYYLGVMNPQNKPVIDNAVCNDAKGYQKMVY KMFPEISKMVTKCSTQLNAVKAHFEDNTNDFVLDDTDKFISDLTITKEIYD LNNVLYDGKKKFQIDYLRNTGDFAGYHKALETWIDFVKEFLSKYRSTAIY DLTTLLPTNYYEKLDVFYSDVNNLCYKIDYENISVEQVNEWVEEGNLYLF KIYNKDFATGSTGKPNLHTMYWNAVFAEENLHDVVVKLNGGAELFYRP KSNMPKVEHRVGEKLVNRKNVNGEPIADSVHKEIYAYANGKISKSELSEN AQEELPLAIIKDVKHNITKDKRYLSDKYFFHVPITLNYKANGNPSAFNTKV QAFLKNNPDVNIIGIDRGERNLLYVVVIDQQGNIIDDKKQVSYNKVNGYDY YEKLNQREKERIEARQSWGAVGKIKELKEGYLSLVVREIADMMVKYNAI VVMENLNAGFKRVRGGIAEKAVYQKFEKMLIDKLNYLVFKDVEAKEAG GVLNAYQLTDKFDSFEKMGNQSGFLFYVPAAYTSKIDPVTGFANVFSTKH ITNTEAKKEFICSFNSLRYDEAKDKFVLECDLNKFKIVANSHIKNWKFIIGG KRIVYNSKNKTYMEKYPCEDLKATLNASGIDFSSSEHNLLKNVPANREYG KLFDETYWAIMNTLQMRNSNALTGEDYIISAVADDNEKVFDSRTCGAELP KDADANGAYHIALKGLYLLQRIDISEEGEKVDLSIKNEEWFKFVQQKEYA R |
| SEQ ID NO: 572 | Cas12 variant | MKEQFINRYPLSKTLRFSLIPVGETENNFNKNLLLKKDKQRAENYEKVKC YIDRFHKEYIESVLSKARIEKVNEYANLYWKSNKDDSDIKAMESLENDMR KQISKQLTSTEIYKKRLFGKELICEDLPSFLTDKDERETVECFRSFTTYFKG FNTNRENMYSSDGKSTAIAYRCINDNLPRFLDNVKSFQKVFDNLSDETITK LNTDLYNIFGRNIEDIFSVDYFEFVLTQSGIEIYNSMIGGYTCSDKTKIQGL NECINLYNQQVAKNEKSKKLPLMKPLYKQILSEKDSVSFIPEKFNSDNEVL HAIDDYYTGHIGDFPDLLTELLQSLNTYNANGIFVKSGVAITDISNGAFNSW NVLRSAWNEKYEALHPVTSKTKIDKYIEKQDKIYKAIKSFSLFELQSLGNE NGNEITDWYISSINESNSKIKEAYLQAQKLLNSDYEKSYNKRLYKNEKAT ELVKNLLDAIKEFQKLIKPLNGTKEENKDELFYGKFTSYYDSIADIDRLY DKVRNYITQKPYSKDKIKLNFDNPQLLGGWDKNKESDYRTVLLHKDGLY YLAVMDKSHSKAFVDAPEITSDDKDYYEKMEYKLLPGPNKMLPKVFFAS KNIDTFQPSDRILDIRKRESFKKGATFNKAECHEFIDYFKDSIKKHDDWSQ FGFKFSPTESYNDISEFYREISDQGYSVRFNKISKNYIDGLVNNGYIYLFQIY NKDFSKYSKGTPNLHTLYFKMLFDERNLSNVVYKLNGEAEMFYREASIG DKEKITHYANQPIKNKNPDNEKKESVFEYDIVKDKRFTKRQFSLHLPITINF KAHGQEFLNYDVRKAVKYKDDNYVIGIDRGERNLIYISVINSNGEIVEQM SLNEIISDNGHKVDYQKLLDTKEKERDKARKNWTSVENIKELKEGYISQV VHKICELVIKYDAVIAMEDLNFGFKRGRFPVEKQVYQKFENMLISKLNLLI DKKAEPTEDGGLLRAYQLTNKFDGVNKAKQNGIIFYVPAWDTSKIDPAT GFVNLLKPKCNTSVPEAKKLFETIDDIKYNANTDMFEFYIDYSKFPRCNSD FKKSWTVCTNSSRILTFRNKEKNNKWDNKQIVLTDEFKSLFNEFGIDYKG NLKDSILSISNADFYRRLIKLLSLTLQMRNSITGSTLPEDDYLISPVANKSGE FYDSRNYKGTNAALPCDADANGAYNIARKALWAINVLKDTPDDMLNKA KLSITNAEWLEYTQK |

TABLE 1-continued

Cas12 Sequences

| SEQ ID NO | Description | Sequence |
|---|---|---|
| SEQ ID NO: 573 | Cas12 variant | MNNPRGAFGGFTNLYSLSKTLRFELKPYLEIPEGEKGKLFGDDKEYYKNC KTYTEYYLKKANKEYYDNEKVKNTDLQLVNFLHDERIEDAYQVLKPVFD TLHEEFITDSLESAEAKKIDFGNYYGLYEKQKSEQNKDEKKKIDKPLETER GKLRKAFTPIYEAEGKNLKNKAGKEKKDKDILKESGFKVLIEAGILKYIKN NIDEFADKKLKNNEGKEITKKDIETALGAENIEGIFDGFFTYFSGFNQNREN YYSTEEKATAVASRIVDENLSKFCDNILLYRKNENDYLKIFNFLKNKGKD LKLKNSKFGKENEPEFIPAYDMKNDEKSFSVADPVNCLSQGEIEKYNAKI ANANYLINLYNQNKDGNSSKLSMFKILYKQIGCGEKKDFIKTIKDNAELK QILEKACEAGKKYFIRGKSEDGGVSNIFDFTDYIQSHENYKGVYWSDKAI NTISGKYFANWDTLKNKLGDAKVFNKNTGEDKADVKYKVPQAVMLSEL FAVLDDNAGEDWREKGIFFKASLFEGDQNKSEIIKNANRPSQALLKMICD DMESLAKNFIDSGDKILKISDRDYQKDENKQKIKNWLDNALWINQILKYF KVKANKIKGDSIDARIDSGLDMLVFSSDNPAEDYDMIRNYLTQKPQDEIN KLKLNFENSSLAGGWDENKEKDNSCIILKDEQDKQYLAVMKYENTKVFE QKNSQLYIADNAAWKKMIYKLVPGASKTLPKVFFSKKWTANRPTPSDIV EIYQKGSFKKENVDFNDKKEKDESRKEKNREKIIAELQKTCWMDIRYNID GKIESAKYVNKEKLAKLIDFYKENLKKYPSEEESWDRLFAFGFSDTKSYK SIDQFYIEVDKQGYKLEFVTINKARLDEYVRDGKIYLFEIRSRDNNLVNGE EKTSAKNLQTIYWNAAFGGDDNKPKLNGEAEIFYRPAIAENKLNKKKDK NGKEIIDGYRFSKEKFIPHCPITLNFCLKETKINDKLNAALAKPENGQGVYF LGIDRGEKHLAYYSLVNQKGEILEQGTLNLPFLDKNGKSRSIKVEKKSFEK DSNGGIIKDKDGNDKIKIEFVECWNYNDLLLDARAGDRDYARKNWTTIGTI KELKDGYISQVVRKIVDLSIYKNTETKEFREMPAFIVLEDLNIGFKRGRQKI EKQVYQKLELALAKKLNFLVDKKADIGEIGSVTKAIQLTPPVNNFGDMEN RKQFGNMLYIRADYTSQTDPATGWRKSIYLKSGSESNVKEQIEKSFFDIRY ESGDYCFEYRDRHGKMWQLYSSKNGVSLDRFHGERNNSKNVWESEKQP LNEMLDILFDEKRFDKSKSLYEQMFKGGVALTRLPKEINKKDKPAWESLR FVIILIQQIRNTGKNGDDRNGDFIQSPVRDEKTGEHFDSRIYLDKEQKGEK ADLPTSGDANGAYNIARKGIVVAEHIKRGFDKLYISDEEWDTWLAGDEIW DKWLKENRESLTKTRK |
| SEQ ID NO: 574 | Cas12 variant | MNGNRIIVYREFVGVTPVAKTLRNELRPIGHTQEHIIHNGLIQEDELRQEKS TELKNIMDDYYREYIDKSLSGVTDLDFTLLFELMNLVQSSPSKDNKKALE KEQSKMREQICTHMQSDSNYKNIFNAKFLKEILPDFIKNYNQYDAKDKAG KLETLALFNGFSTYFTDFFEKRKNVFTKEAVSTSIAYRIVHENSLTFLANM TSYKKISEKALDEIEVIEKNNQDKMGDWELNQIFNPDFYNMVLIQSGIDFY NEICGVVNAHMNLYCQQTKNNYNLFKMRKLHKQILAYTSTSFEVPKMFE DDMSVYNAVNAFIDETEKGNIIGKLKDIVNKYDELDEKRIYISKDFYETLS CFMSGNWNLITGCVENFYDENIHAKGKSKEEKVKKAVKEDKYKSINDVN DLVEKYIDEKERNEFKNSNAKQYIREISNIITDTETAHLEYDEHISLIESEEK ADEMKKRLDMYMNMYHWAKAFIVDEVLDRDEMFYSDIDDIYNILENIVP LYNRVRNYVTQKPYNSKKIKLNFQSPTLANGWSQSKEFDNNAIILIRDNK YYLAIFNAKNKPDKKIIQGNSDKKNDNDYKKMVYNLLPGANKMLPKVFL SKKGIETFKPSDYIISGYNAHKHIKTSENFDISFCRDLIDYFKNSIEKHAEWR KYEFKFSATDSYNDISEFYREVEMQGYRIDWTYISEADINKLDEEGKIYLF QIYNKDFAENSTGKENLHTMYFKNIFSEENLKDIIIKLNGQAELFYRRASV KNPVKHKKDSVLVNKTYKNQLDNGDVVRIPIPDDIYNEIYKMYNGYIKEN DLSEAAKEYLDKVEVRTAQKDIVKDYRYTVDKYFIHTPITINYKVTARNN VNDMAVKYIAQNDDIHVIGIDRGERNLIYISVIDSHGNIVKQKSYNILNNY DYKKKLVEKEKTREYARKNWKSIGNIKELKEGYISGVVHEIAMLMVEYN AIIAMEDLNYGFKRGRFKVERQVYQKFESMLINKLNYFASKGKSVDEPGG LLKGYQLTYVPDNIKNLGKQCGVIFYVPAAFTSKIDPSTGFISAFNFKSIST NASRKQFFMQFDEIRYCAEKDMFSFGFDYNNFDTYNITMSKTQWTVYTN GERLQSEFNNARRTGKTKSINLTETIKLLLEDNEINYADGHDVRIDMEKM DEDKNSEFFAQLLSLYKLTVQMRNSYTEAEEQEKGISYDKIISPVINDEGE FFDSDNYKESDDKECKMPKDADANGAYCIALKGLYEVLKIKSEWTEDGF DRNCLKLPHAEWLDFIQNKRYE |
| SEQ ID NO: 575 | Cas12 variant | MKKIDSFVNYYPLSKTLRFSLIPVGKTEDNFNAKLLLEEDEKRAIEYEKVK RYIDRYHKHFIETVLANPHLDDVNEYAELYYKAGKDDKDLKFMEKLEG KMRKSISAAFTKDKKYKEIFGQEIIKNILPEFLENEDEKESVKMFQGFFTYF TGFNDNRKNMYTHEAQTTAISYRCINENLPKFLDNVQSFAKIKESISSDIM NKLDEVCMDLYGVYAQDMFCTDYFSFVLSQSGIDRYNNIIGGYVDDKGV KIQGINEYINLYNQQVDEKNKRLPLMKKLYKQILIEKESISFIPEKFESDNIV INAISDYYHNNVENLFDDFNKLFNEFSEYDDNGIFVTSGLAVTDISNAVFG SWNIISDSWNEEYKDSHPMKKTTNAEKYYEDMKKEYKKNLSFTIAELQR LGEAGCNDECKGDIKEYYKTTVAEKIENIKNAYEISKDLLASDYEKSNDK KLCKNDSAISLLKNLLDSIKDLEKTIKPLLGTGEENKDDVKFTNLYE MISEIDRLYDKVRNYVTQKPYSKDKIKLNFENPQHLGGWDKNKERDYRS VLLKKEDKYYLAIMDKSNNKAFIDPDDGECYEKIEYKLLPGPNKMLPKV FFASSNIEYFAPSKKILEIRSRESFKKGDMFNLKDCHEFIDFFKESIKKHED WSQFGFEFSPTEKYNDISEFYNEVKIQGYSLKYKNVSKKYIDELIECGQLY LFQIYNKDFSVYAKGNPNLHTMYFKMLFDERNLANVVYQLNGGAEMFY |

TABLE 1-continued

Cas12 Sequences

| SEQ ID NO | Description | Sequence |
|---|---|---|
| | | RKASIKDSEKIVHHANQPIKNKNADNVKKESVFEYDIIKDKRFTKRQFSIHI PITLNFKAKGQNFINNDVRMALKKADENYVIGIDRGERNLLYICVINSKGE IVEQKSLNEIIGDNGYRVDYHKLLDKKEAERDEARKSWGTIENIKELKEG YLSQIVHEISKLVIKYDAVIAIEDLNSGFKKGRFKVEKQVYQKFENMLCTK LNYLVDKNADANECGGLLKAYQLTNKEDGANRGRQNGIIFSVPAWLTSK IDPVTGFADLLRPKYKSVSESVEFISKIDNIRYNSKEDYFEFDIDYSKFPNST ASYKKKWTVCTYGERIINVRNKEKNNMWDNKTIVLTDEFKKLFADFGVD VSKNIKESVLAIDSKDFYYRFINLLANTLQLRNSEVGNVDVDYLISPVKGV DGSFYDSRLVKEKTLPENADANGAYNIARKALWAIDVLKQTKDEELKNA NLSIKNAEWLEYVQK |
| SEQ ID NO: 576 | Cas12 variant | MRTMVTFEDFTKQYQVSKTLRFELIPQGKTLENMKRDGIISVDRQRNEDY QKAKGILDKLYKYILDFTMETVVIDWEALATATEEFRKSKDKKTYEKVQS KIRTALLEHVKKQKVGTEDLFKGMFSSKIITGEVLAAFPEIRLSDEENLILE KFKDFTTYFTGFFENRKNVFTDEALSTSFTYRLVNDNFIKFFDNCIVFKNV VNISPHMAKSLETCASDLGIFPGVSLEEVFSISFYNRLLTQTGIDQFNQLLG GISGKEGEHKQQGLNEIINLAMQQNLEVKEVLKNKAHRFTPLFKQILSDRS TMSFIPDAFADDDEVLSAVDAYRKYLSEKNIGDRAFQLISDMEAYSPELM RIGGKYVSVLSQLLFYSWSEIRDGVKAYKESLITGKKTKKELENIDKEIKY GVTLQEIKEALPKKDIYEEVKKYAMSVVKDYHAGLAEPLPEKIETDDERA SIKHIMDSMLGLYRFLEYFSHDSIEDTDPVFGECLDTILDDMNETVPLYNK VRNFSTRKVYSTEKFKLNFNNSSLANGWDKNKEQANGAILLRKEGEYFL GIFNSKNKPKLVSDGGAGIGYEKMIYKQFPDFKKMLPKCTISLKDTKAHF QKSDEDFTLQTDKFEKSIVITKQIYDLGTQTVNGKKKFQVDYPRLTGDME GYRAALKEWIDFGKEFIQAYTSTAIYDTSLFRDSSDYPDLPSFYKDVDNIC YKLTFEWIPDAVIDDCIDDGSLYLFKLHNKDFSSGSIGKPNLHTLYWKALF EEENLSDVVVKLNGQAELFYRPKSLTRPVVHEEGEVIINKTTSTGLPVPDD VYVELSKFVRNGKKGNLTDKAKNWLDKVTVRKMPHAITKDRRFTVDKF FFHVPITLNYKADSSPYRFNDFVRQYIKDCSDVKIIGIDRGERNLIYAVVID GKGNIIEQRSFNTVGTYNYQEKLEQEKEKERQTARQDWATVTKIKDLKKG YLSAVVHELSKMIVKYKAIVALENLNVGFKRMRGGIAERSVYQQFEKALI DKLNYLVFKDEEQSGYGGVLNAYQLTDKFESFSKMGQQTGFLFYVPAAY TSKIDPLTGFINPFSWKHVKNREDRRNFLNLFSKLYYDVNTHDPVLAYHH SNKDSKYTIKGNWEIADWDILIQENKEVFGKTGTPYCVGKRIVYMDDSTT GHNRMCAYYPHTELKKLLSEYGIEYTSGQDLLKIIQEFDDDKLVKGLFYII KAALQMRNSNSETGEDYISSPIEGRPGICFDSRAEADTLPYDADANGAFHI AMKGLLLTERIRNDDKLAISNEEWLNYIQEMRG |
| SEQ ID NO: 577 | Cas12 variant | MNKDIRKNFTDFVGISEIQKTLRFILIPIGKTAQNIDKYNMFEDDEIRHEYY PILKEACDDFYRNHIDQQFENLELDWSKLDEALASEDRDLINETRATYEQ VLFNRLKNSVDIKGDSKKNKTLSLESSDKNLGKKKTKNTFQYNFNDLFK AKLIKAILPLYIEYIYEGEKLENAKKALKMYNRFTSRLSNFWQARANIFTD DEISTGSPYRLVNDNFTIFRINNSIYTKNKPFIEEDILEFEKKLKSKKIIKDFE SVDDYFTVNAFNKLCTQNGIDKYNSILGGFTTKEREKVKGLNELFNLAQQ SINKGKKGEYRKNIRLGKLTKLKKQILAISDSTSFLIEQIEDDQDLYNKIKD FFELLLKEEIENENIFTQYANLQKLIEQADLSKIYINAKHLNKISHQVTGKW DSLNKGIALLLENININEESKEKSEVISNGQTKDISSEAYKRYLQIQSEEKDI ERLRTQIYFSLEDLEKALDLVLIDENMDRSDKSILSYVQSPDLNVNFERDL TDLYSRIMKLEENNEKLLANHSAIDLIKEFLDLIMLRYSRWQILFCDSNYE LDQTFYPIYDAVMEILSNIIRLYNLARNYLSRKPDRMKKKKINFNNPTLAD GWSESKIPDNSSMLFIKDGMYYLGIIKNRAAYSELLEAESLQSSEKKKSEN SSYERMNYHFLPDAFRSIPKSSIAMKAVKEHFEINQKTADLLLDTDKFSKP LRITKEIFDMQYVDLHKNKKKYQVDYLRDTGDKKGYRKALNTWLNFCK DFISKYKGRNLFDYSKIKDADHYETVNEFYNDVDKYSYHIFFTSVAETTV EKFISEGKLYLFQLYNKDFSPHSTGKPNLHTIYWRALFSEENLTSKNIKLN GQAEIFFRPKQIETPFTHKKGSILVNRFDVNGNPIPINVYQEIKGFKNNVIK WDDLNKTTQEGLENDQYLYFESEFEIIKDRRYTEDQLFFHVPISFNWDIGS NPKINDLATQYIVNSNDIHIIGIDRGENHLIYYSVIDLQGAIVEQGSLNTITE YTENKFLNNKTNNLRKIPYKDILQQREDERADARIKWHAIDKIKDLKDGY LGQIVHFLAKLIIKYNAIVILEDLNYGFKRGRFKVERQVYQKFEMALMKK LNVLVFKDYDIDEIGGPLKPWQLTRPIDSYERMGRQNGILFYVPAAYTSA VDPVTGFANLFYLNNVKNSEKFHFFSKFESIKYHSDQDMFSFAFDYNNFG TTTRINDLSKSKWQVFTNHERSVWNNKEKNYVTQNLTDLIKKLLRTYNIE FKNNQNVLDSILKIENNTDKENFARELFRLFRLTIQLRNTTVNENNTEITEN ELDYIISPVKDKNGNFFDSRDELKNLPDNGDANGAYNIARKGLLYIEQLQE SIKTGKLPTLSISTLDWFNYIMK |
| SEQ ID NO: 578 | Cas12 variant | MTPIFCNFVVYQIMLFNNNININVKTMNKKHLSDFTNLFPVSKTLRFRLEP QGKTMENIVKAQTIETDEERSHDYEKTKEYIDDYHRQFIDDTLDKFAFKV ESTGNNDSLQDYLDAYLSANDNRTKQTEEIQTNLRKAIVSAFKMQPQFNL LFKKEMVKHLLPQFVDTDDKKRIVAKFNDFTTYPTGFFTNRENMYSDEA KSTSIAYRIVNQNLIKFVENMLTFKSHILPILPQEQLATLYDDFKEYLNVAS IAEMFELDHFSIVLTQRQIEVYNSVIGGRKDENNKQIKPGLNQYINQHNQA VKDKSARLPLLKPLFNQILSEKAGVSFLPKQFKSASEVVKSLNEAYAELSP |

TABLE 1-continued

Cas12 Sequences

| SEQ ID NO | Description | Sequence |
|---|---|---|
| | | VLAAIQDVVTNITDYDCNGIFIKNDLGLTDIAQRFYGNYDAVKRGLRNQY ELETPMHNGQKAEKYEEQVAKHLKSIESVSLAQINQVVTDGGDICDYFKA FGATDDGDIQRENLLASINNAHTAISPVLNKENANDNELRKNTMLIKDLL DAIKRLQWFAKPLLGAGDETNKDQVFYGKFEPLYNQLDETISPLYDKVRS YLTKKPYSLDKFKINFEKSNLLGGWDPGADRKYQYNAVILRKDNDFYLGI MRDEATSKRKCIQVLDCNDEGLDENFEKVEYKQIKPSQNMPRCAFAKKE CEENADIMELKRKKNAKSYNTNKDDKNALIRHYQRYLDRTYPEFGFVYK DADEYDTVKAFTDSMDSQDYKLSFLQVSETGLNKLVDEGDLYLFKITNK DFSSYAKGRPNLHTIYWRMLFDPKNLANVVYKLEGKAEVFFRRKSLAST TTHKAKQAIKNKSRYNEAVKPQSTFDYDIIKDRRFTADKFEFHVPIKMNF KAAGWNSTRLTNEVREFIKSQGVRHIIGIDRGERHLLYLTMIDMDGNIVK QCSLNAPAQDNARASEVDYHQLLDSKEADRLAARRNWGTIENIKELKQG YLSQVVHLLATMMVDNDAILVLENLNAGFMRGRQKVEKSVYQKFEKML IDKLNYIVDKGQSPDKPTGALHAVQLTGLYSDFNKSNMKRANVRQCGFV FYIPAWNTSKIDPVTGFVNLFDTHLSSMGEIKAFFSKFDSIRYNQDKGWFE FKFDYSRFTTRAEGCRTQWTVCTYGERIWTHRSKNQNNQFVNDTVNVTQ QMLQLLQDCGIDPNGNLKEAIANIDSKKSLETLLHLFKLTVQMRNSVTGS EVDYMISPVADERGHFFDSRESDEHLPANADANGAFNIARKGLMVVRQI MATDDVSKIKFAVSNKDWLRFAQHIDD |
| SEQ ID NO: 579 | Cas12 variant | MNKGGYVIMEKMTEKNRWENQFRITKTIKEEIIPTGYTKVNLQRVNMLK REMERNEDLKKMKEICDEYYRNMIDVSLRLEQVRTLGWESLIHKYRMLN KDEKEIKALEKEQEDLRKKISKGFGEKKAWTGEQFIKKILPQYLMDHYTG EELEEKLRIVKKFKGCTMFLSTFFKNRENIFTDKPIHTAVGHRITSENAMLF AANINTYEKMESNVTLEIERLQREFWRRGINISEIFTDAYYVNVLTQKQIE AYNKICGDINQHMNEYCQKQKLKFSEFRMRELKKQILAVVGEHFEIPEKI ESTKEVYRELNEYYESLKELHGQPEELKSVQLKYSQIYVQKKGYDRISRYI GGQWDLIQECMKKDCASGMKGTKKNHDAKIEEEVAKVKYQSIEHIQKLV CTYEEDRGHKVTDYVDEFIVSVCDLLGADHIITRDGERIELPLQYEPGTDL LKNDTINQRRLSDIKTILDWHMDMLEWLKTFLVNDLVIKDEEFYMAIEEL NERMQCVISVYNRIRNYVTQKGYEPEKIRICFDKGTILTGWTTGDNYQYS GFLLMRNDKYYLGIINTNEKSVRKILDGNEECKDENDYIRVGYHLINDAS KQLPRIFVMPKAGKKSEILMKDEQCDYIWDGYCHNKHNESKEFMRELID YYKRSIMNYDKWEGYCFKFSSTESYDNMQDFYKEVREQSYNISFSYINEN VLEQLDKDGKIYLFQVYNKDFAAGSTGTPNLHTMYLQNLFSSQNLELKR LRLGGNAELFYRPGTEKDVTHRKGSILVDRTYVREEKDGIEVRDTVPEKE YLEIYRYLNGKQGDLSESAKQWLDKVHYREAPCDIIKDKRYAQEKYFL HFSVEINPNAEGQTALNDNVRRWLSEEEDIHVIGIDRGERNLIYVSLMDGK GRIKDQKSYNIVSGNKEPVDYLAKLKVREKERDEARRNWKAIGKIKDIK TGYLSYVVHEIVEMAVREKAIIVMEDLNYGFKRGRFKVERQVYQKFEEM LINKLNYVVDKQLSVDEPGGLLRGYQLAFIPKDKKSSMRQNGIVFYVPAG YTSKIDPTTGFVNIFKFPQFGKGDDDGNGKDYDKIRAFFGKFDEIRYECDE KVTADNTREVKERYRFDFDYSKFETHLVHMKKTKWTVYAEGERIKRKK VGNYWTSEVISDIALRMSNTLNIAGIEYKDGHNLVNEICALRGKQAGIILN ELLEIVRLTVQLRNSTTEGDVDERDEIISPVLNEKYGCFYHSTEYKQQNGD VLPKDADANGAYCIGLKGIYEIRQIKNKWKEDMTKGEGKALNEGMRISH DQWFEFIQNMNKGE |
| SEQ ID NO: 580 | Cas12 variant | MNELVKNRCKQTKTICQKLIPIGKTRETIEKYNLMEIDRKIAANKELMNKL FSLIAGKHINDTLSKCTDLDFEPLLTSLSSLNNAKENDRDNLREYYDSVFE EKKTLAEEISSRLTAVKFAGKDFFTKNIPDFLETYEGDDKNEMSELVSLVI ENTVTAGYVKKLEKIDRSMEYRLVSGTVVKRVLTDNADIYEKNIEKAKD FDYGVLNIDEASQFTTLVAKDYANYLTADGIAIYNVGIGKINLALNEYCQ KNKEYSYNKLALLPLQKMLYGEKLSLFEKLEDFTSDEELINSYNKFAKTV NESGLAEIIKKAVPSYDEIVIKPNKISNYSNSITGHWSLVNRIMKDYLENNG IKNADKYMEKGLTLSEIGDALENKNIKHSDFISNLINDLGHTYTEIKENKES LKKDESVNALIIKKELDMLLSILQNLKVFDIDNEMFDTGFGIEVSKAIEILG YGVPLYNKIRNYITKKPDPKKKFMTKFGSATIGTGITTSVESKKATFLKD GDAVFLLLYNTAGCKANNVSVSNLADLINSSLEIENSGKCYQKMIYQTPG DIKKQIPRVFVYKSEDDDLIKDFKAGLHKTDLSFLNGRLIPYLKEAFATHE TYKNYTFSYRNSYESYDEFCEHMSEQAYILEWKWIDKKLIDDLVEDGSLL MFRVWNRFMKKKEGKISKHAKIVNELFSDENASNAAIKLLSVFDIFYRDK QIDNPIVHKAGTTLYNKRTKDGEVIVDYTTMVKNKEKRPNVYTTTKKYDI IKDRRYTEEQFEIHLHVNIGKEENKEKLETSKVINEKKNTLVVTRSNEHLL YVVIFDENDNILLKKSLNTVKGMNFKSKLEVVEIQKKENMQSWKTVGSN QALMEGYLSFAIKEIADLVKEYDAILVLEQNSVGKNILNERVYTRFKEMLI TNLSLDVDYENKDFYSYTELGGKVASWRDCVTNGICIQVPSAYKYKDPT TSFSTISMYAKTTAEKSKKLKQIKSFKYNRERGLFELVIAKGVGLENNIVC DSFGSRSIIENDISKEVSCTLKIEKYLIDAGIEYNDEKEVLKDLDTAAKTDA VHKAVTLLLKCFNESPDGRYYISPCGEHFTLCDAPEVLSAINYYIRSRYIRE QIVEGVKKMEYKKTILLAK |

TABLE 1-continued

Cas12 Sequences

| SEQ ID NO | Description | Sequence |
|---|---|---|
| SEQ ID NO: 581 | Cas12 variant | MNYKTGLEDFIGKESLSKTLRNALIPTESTKIHMEEMGVIRDDELRAEKQQ ELKEIMDDYYRTFIEEKLGQIQGIQWNSLFQKMEETMEDISVRKDLDKIQN EKRKEICCYFTSDKRFKDLFNAKLITDILPNFIKDNKEYTEEEKAEKEQTRV LFQRFATAFTNYFNQRRNNFSEDNISTAISFRIVNENSEIHLQNMRAFQRIE QQYPEEVCGMEEEYKDMLQEWQMKHIYSVDFYDRELTQPGIEYYNGICG KINEHMNQFCQKNRINKNDFRMKKLHKQILCKKSSYYEIPFRFESDQEVY DALNEFIKTMKKKEIIRRCVHLGQECDDYDLGKIYISSNKYEQISNALYGS WDTIRKCIKEEYMDALPGKGEKKEEKAEAAAKKEEYRSIADIDKIISLYGS EMDRTISAKKCITEICDMAGQISIDPLVCNSDIKLLQNKEKTTEIKTILDSFL HVYQWGQTFIVSDIIEKDSYFYSELEDVLEDFEGITTLYNHVRSYVTQKPY STVKFKLHFGSPTLANGWSQSKEYDNNAILLMRDQKFYLGIFNVRNKPD KQIIKGHEKEEKGDYKKMIYNLLPGPSKMLPKVFITSRSGQETYKPSKHIL DGYNEKRHIKSSPKFDLGYCWDLIDYYKECIHKHPDWKNYDFHFSDTKD YEDISGFYREVEMQGYQIKWTYISADEIQKLDEKGQIFLFQIYNKDFSVHS TGKDNLHTMYLKNLFSEENLKDIVLKLNGEAELFFRKASIKTPIVHKKGSV LVNRSYTQTVGNKEIRVSIPEEYYTEIYNYLNHIGKGKLSSEAQRYLDEGK IKSFTATKDIVKNYRYCCDHYFLHLPITINFKAKSDVAVNERTLAYIAKKE DIHIIGIDRGERNLLYISVVDVHGNIREQRSFNIVNGYDYQQKLKDREKSR DAARKNWEEIEKIKELKEGYLSMVIHYIAQLVVKYNAVVAMEDLNYGFK TGRFKVERQVYQKFETMLIEKLHYLVFKDREVCEEGGVLRGYQLTYIPES LKKVGKQCGFIFYVPAGYTSKIDPTTGFVNLFSFKNLTNRESRQDFVGKFD EIRYDRDKKMFEFSFDYNNYIKKGTILASTKWKVYTNGTRLKKIVVNGKY TSQSMEVELTDAMEKMLQRAGIEYHDGKDLKGQIVEKGIEAEHDIFRLTV QMRNSRSESEDREYDRLISPVLNDKGEFFDTATADKTLPQDADANGAYCI ALKGLYEVKQIKENWKENEQFPRNKLVQDNKTWFDFMQKKRYL |
| SEQ ID NO: 582 | Cas12 variant | MEDKQFLERYKEFIGLNSLSKTLRNSLIPVGSTLKHIQEYGILEEDSLRAQK REELKGIMDDYYRNYIEMHLRDVHDIDWNELFEALTEVKKNQTDDAKKR LEKIQEKKRKEIYQYLSDDAVFSEMFKEKMISGILPDFIRCNEGYSEEEKEE KLKTVALFHRFTSSFNDFFLNRKNVFTKEAIVTAIGYRVVHENAEIFLENM VAFQNIQKSAESQISIIERKNEHYFMEWKLSHIPTADYYMMLMTQKAIEH YNEMCGVVNQQMREYCQKEKKNWNLYRMKRLHKQILSNASTSFKIPEK YENDAEVYESVNSFLQNVMEKTVMERIAVLKNSTDNFDLSKIYITAPYYE KISNYLCGSWNTITDCLTHYYEQQIAGKGARKDQKVKAAVKADKWKSLS EIEQLLKEYARAEEVKRKPEEYIAEIENIVSLKEAHLLEYHPEVNLIENEKY ATEIKDVLDNYMELFHWMKWFYIEEAVEKEVNFYGELDDLYEEIKDIVPL YNKVRNYVTQKPYSDTKIKLNFGTPTLANGWSKSKEYDYNAILLQKDGK YYMGIFNPIQKPEKEHEGHSQPLEGNEYKKMVYYYLPSANKMLPKVLLS KKGMEIYQPSEYIINGYKERRHIKSEEKFDLQFCHDLIDYFKSGIERNSDW KVFGFDFSDTDTYQDISGFYREVEDQGYKIDWTYIKEADIDRLNEEGKLY LFQIYNKDFSEKSTGRENLHTMYLKNLFSEENVREQVLKLNGEAEIFFRKS SVKKPIIHKKGTMLVNRTYMEEVNGNSVRRNIPEKEYQEIYNYKNHRLKG ELSTEAKKYLEKAVCHETKKDIVKDYRYSVDKFFIHLPITINYRASGKETL NSVAQRYIAHQNDMHVIGIDRGERNLIYVSVINMQGEIKEQKSFNIINEFN YKEKLKEREQSRGAARRNWKEIGQIKDLKEGYLSGVIHEIAKMMIKYHAI IAMEDLNYGFKRGRFKVERQVYQKFENMLIQKLNYLVFKDRPADEDGGV LRGYQLAYIPDSVKKMGRQCGMIFYVPAAFTSKIDPTTGFVDIFKHKVYT TEQAKREFILSFDEICYDVERQLFRFTFDYANFVTQNVTLARNNWTIYTNG TRAQKEFGNGRMRDKEDYNPKDKMVELLESEGIEFKSGKNLLPALKKVS NAKVFEELQKIVRFTVQLRNSKSEENDVDYDHVISPVLNEEGNFFDSSKY KNKEEKKESLLPVDADANGAYCIALKGLYIMQAIQKNWSEEKALSPDVL RLNNNDWFDYIQNKRYR |
| SEQ ID NO: 583 | Cas12 variant | MEKSLNDFIGLYSVSKTLRFELKPVSETLENIKKFHFLEEDKKKANDYKD VKKIIDNYHKYFIDDVLKNASFNWKKLEEAIREYNKNKSDDSALVAEQK KLGDAILKLFTSDKRYKALTAATPKELFESILPDWFGEQCNQDLNKAALK TFQKFTSYFTGFQENRKNVYSAEAIPTAVPYRIVNDNPKFLQNVLIFKTIQ EKCPQIIDEVEKELSSYLGKEKLAGIFTLESFNKYLGQGGKENQRGIDFYN QIIGGVVEKEGGINLRGVNQFLNLYWQQHPDFTKEDRRIKMVPLYKQILS DRSSLSFKIESIENDEELKNALLECADKLELKNDEKKSIFEEVCDLFSSVKN LDLSGIYINRKDINSVSRILTGDWSWLQSRMNVYAEEKFTTKAEKARWQK SLDDEGENKSKGFYSLTDLNEVLEYSSENVAETDIRITDYFEHRCRYYVD KETEMFVQGSELVALSLQEMCDDILKKRKAMNTVLENLSSENKLREKTD DVAVIKEYLDAVQELLHRIKPLKVNGVGDSTFYSVYDSIYSALSEVISVYN KTRNYITKKAASPEKYKLNFDNPTLADGWDLNKEQANTSVILRKDGMFY LGIMNPKNKPKFAEKYDCGNESCYEKMIYKQFDATKQIPKCSTQKKEVQ KYFLSGATEPYILNDKKSFKSELIITKDIWFMNNHVWDGEKFVPKRDNET RPKKFQIGYFKQTGDFDGYKNALSNWISFCKNFLQSYLSATVYDYNFKNS EEYEGLDEFYNYLNATCYKLNFINIPETEINKMVSEGKLYLFQIYNKDFAS GSTGMPNMHTLYWKNLFSDENLKNVCLKLNGEAELFYRPAGIKEPVIHK EGSYLVNRTTEDGESIPEKIYFEIYKNANGKLEKLSDEAQNYISNHEVVIK KAGHEIIKDRHYTEPKFLFHVPLTINFKASGNSYSINENVRKFLKNNPDVNI IGLDRGERHLIYLSLINQKGEIIKQFTFNEVERNKNGRTIKVNYHEKLDQRE KERDAARKSWQAIGKIAELKEGYLSAVIHQLTKLMVEYNAVVVMEDLNF |

TABLE 1-continued

Cas12 Sequences

| SEQ ID NO | Description | Sequence |
|---|---|---|
| | | GFKRGRFHVEKQVYQKFEHILIDKSNYLVFKDRGLNEPGGVLNGYQIAGQ FESFQKLGKQSGMLFYVPAGYTSKIDPKTGFVSMMNFKDLTNVHKKRDF FSKFDNIHYDEANGSFVFTFDYKKFDGKAKEEMKLTKWSVYSRDKRIVY FAKTKSYEDVLPTEKLQKIFESNGIDYKSGNNIQDSVMAIGADLKEGAKPS KEISDFWDGLLSNFKLILQMRNSNARTGEDYIISPVMADDGTFFDSREEFK KGEDAKLPLDADANGAYHIALKGLSLINKINLSKDEELKKFDMKISNADW FKFAQEKNYAK |
| SEQ ID NO: 584 | Cas12 variant | MEEKKMSKIEKFIGKYKISKTLRFRAVPVGKTQDNIEKKGILEKDKKRSED YEKVKAYLDSLHRDFIENTLKKVKLNELNEYACLFFSGTKDDGDKKKME KLEEEKMRKTISNEFCNDEMYKKIFSEKILSENNEEDVSDIVSSYKGFFTSLN GYVNNRKNLYVSDAKPTSIAYRCINENLPKFLRNVECYKKVVQVIPKEQI EYMSNNLNLSPYRIEDCFNIDFFEFCLSQGGIDLYNTFIGGYSKKDGTKVQ GINEIVNLYNQKNKKDKEKYKLPQFTPLFKQILSDRDTKSFSIEKLENIYEV VELVKKSYSDEMFDDIETVFSNLNYYDASGIYVKNGPAITHISMNLTKDW ATIRNNWNYEYEDKHSTKKNKNIEKYEDTRNTMYKKIDSFTLEYISRLVG KDIDELVKYFENEVANFVMDIKKTYSKLTPLFDRCQKENFDISEDEVNDIK GYLDNVKLLESFMKSFTINGKENNIDYVFYGKFTDDYDKLHEFDHIYNKV RNYITTSRKPYKLDKYKLYFDNPQLLGGWDINKEKDYRTVMLTKDGKYY FAIIDKGEHPFDNIPKDYFDNNGYYKKIIYRQIPNAAKYLSSKQIVPQNPPE EVKRILDKKKADSKSLTEEEKNIPIDYIKSDFLKNYKLLFDKNNNPYFNFA FRESSTYESLNEFFEDVERQAYSVRYENLPADYIDNLVNEGKIYLFEIYSK DFSEYSKGTNNLHTMYFKALFDNDNLKNTVFKLSGNAELFIRPASIKKDE LVIHPKNQLLQNKNPLNPKKQSIFDYDLVKDKRFFENQYMLHISIEINKNE RDAKKIKNINEMVRKELKDSDDNYIIGIDRGERNLLYVCVINSAGKIVEQM SLNEHNEYNGIKHTVDYQGLLDKCEKERNAQRQSWKSIENIKELKDGYIS QVVHKLCQLVEKYDAIIAMENLNGGFKRGRTKFEKQVYQKFENKLINKM EYMADKKRKTTENGGILRGYQLTNGCINNSYQNGFIFYVPAWLTSKIDPT TGFVDLLKPKYTNVEEAHLWINKFNSITYDKKLDMFAFNINYSQFPRADI DYRKIWTFYTNGYRIETFRNSEKNNEFDWKEVHLTSVIKKLLEEYQINYIS GKNIIDDLIQIKDKPFWNSFIKYIRLTLQMRNSITGRTDVDYIISPVINNEGT FYDSRKDLDEITLPQDADANGAYNIARKALWIIEKLKESPDEELNKVKLAI TQREWLEYAQINI |
| SEQ ID NO: 585 | Cas12 variant | MIIHNCYIGGSFMKKIDSFTNCYSLSKTLRFKLIPIGATQSNFDLNKMLDED KKRAENYSKAKSIIDKYHRFFIDKVLSSVTENKAFDSFLEDVRAYAELYY RSNKDDSDKASMKTLESKMRKFIALALQSDEGFKDLFGQNLIKKTLPEFL ESDTDKEHAEFDGFSTYFTGFFNNRKNMYSADDQPTAISYRCINDNLPKFL DNVRTFKNSDVASILNDNLKILNEDFDGIYGTSAEDVFNVDYFPPFVLSQK GIEAYNSILGGYTNSDGSKIKGLNEYINLYNQKNENIHRIPKMKQLFKQILS ERESVSFIPEKFDSDDDVLSSINDYYLERDGGKVLSIEKTVEKIEKLFSAVT DYSTDGIFVKNAAELTAVCSGAFGYWGTVQNAWNNEYDALNGYKETEK YIDKRKKAYKSIESFSLADIQKYADVSESSETNAEVTEWLRNEIKEKCNLA VQGYESSKDLISKPYTESKKLFNNDNAVELIKNALDSVKELENVLRLLLGT GKEESKDENFYGEFLPCYERICEVDSLYDKVRNYMTQKLYKTDKIKLNFQ NPQFLGGWDRNKEADYSAVLLRRNSLYYIAIMPSGYKRVFEKIPAPKADE TVYEKVIYKLLPGPNKMLPKVFFSKKGIETFNPPKEILEKYELGTHKTGDG FNLDDCHALIDYFKSALDVHSDWSNFGFRFSDTSTYKNIADFYNEVKNQG YKITFCDVPQSYINELVDEGKLYLFQLYNKDFSEHSKGTPNLHTLYFKML FDERNLENVVFKLNGEAEMFYREASISKDDMIVHPKNQPIKNKNEQNSRK QSTFEYDIVKDRRYTVDQFMLHIPITLNFTANGGTNINNEVRKALKDCDK NYVIGIDRGERNLLYICVVDSEGRIIEQYSLNEHNEYNGNTYSTDYHALLD KKEKERLESRKAWKTVENIKELKEGYISQVVHKICELVEKYDAVIVMEDL NLGFKQGRSGKFEKSVYQKFEKMLIDKLNYFADKKKSPEEIGSVLNAYQL TNAFESFEKMGKQNGFIFYVPAYLTSKIDPTTGFADLLHPSSKQSKESMRD FVGRFDSITFNKTENYFEFELDYNKFPRCNTDYRKKWTVCTYGSRIKTFR NPEKNSEWDNKTVELTPAFMALFEKYSIDVNGDIKAQIMSVDKKDFFVEL IGLLRLTLQMRNSETGKVDRDYLISPVKNSEGVFYNSDDYKGIENASLPK DADANGAYNIARKGLWIIEQIKACENDAELNKIRLAISNAEWLEYAQKK |
| SEQ ID NO: 586 | Cas12 variant | MKEQFVNQYPISKTLRFSLIPIGKTEENFNKNLLLKEDEKKAEEYQKVKGY IDRYHKFFIETALCNINFEGFEEYSLLYYKCSKDDNDLKTMEDIEIKLRKQI SKTMTSHKLYKDLFGENMIKTILPNFLDSDEEKNSLEMFRGFYTYFSGFNT NRKNMYTEEAKSTSIAYRCINDNLPKFLDNSKSFEKIKCALNKEELKAKN EEFYEIFQIYATDIFNIDFFNFVLTQPGIDKYNGIIGGYTCSDGTKVQGLNEII NLYNQQIAKDDKSKRLPLLKMLYKQILSDRETVSFIPEKFSSDNEVLESIN NYFSKNVSNAIKSLKELFQGFEAYNMNGIFISSGVAITDLSNAVFGDWNAI STAWEKAYFETNPPKKNKSQEKYEEELKANYKKIKSFSLDEIQRLGSIAKS PDSIGSVAEYYKITVTEKIDNITELYDGSKELLNCNYSESYDKKLIKNDTVI EKVKTLLDAVKSLEKLIKPLVGTGKEDKDELFYGTFLPLYTSLSAVDRLY DKVRNYATQKPYSKDKIKLNFNCSSFLSGWATDYSSNGGLIFEKDGLYYL GIVNKKFTTEEIDYLQQNADENPAQRIVYDFQKPDNKNTPRLFIRSKGTNY SPSVKEYNLPVEEIVELYDKRYFTTEYRNKNPELYKASLVKLIDYFKLGFT RHESYRHYDFKWKKSEEYNDISEFYKDVEISCYSLKQEKINYNTLLNFVA |

TABLE 1-continued

Cas12 Sequences

| SEQ ID NO | Description | Sequence |
|---|---|---|
| | | ENRIYLFQIYNKDFSKYSKGTPNLHTRYFKALFDENNLSDVVFKLNGGSE MFFRKASIKDNEKVVHPANQPIDNKNPDNSKKQSTFDYELIKDKRFTKHQ FSIHIPITMNFKARGRDFINNDIRKAIKSEYKPYVIGIDRGERNLIYISVINNN GEIVEQMSLNDIISDNGYKVDYQRLLDRKEKERDNARKSWGTIENIKELK EGYISQVIHKICELVIKYDAVIAMEDLNFGFKRGRFNVEKQVYQKFENMLI SKLNYLCDKKSEANSEGGLLKAYQLTNKFDGVNKGKQNGIIFYVPAWLT SKIDPVTGFVDLLHPKYISVEETHSLFEKLDDIRYNFEKDMFEFDIDYSKLP KCNADFKQKWTVCTNADRIMTFRNSEKNNEWDNKRILLSDEFKRLFEEF GIDYCHNLKNKILSISNKDFCYRFIKLFALTMQMRNSITGSTNPEDDYLISP VRDENGVFYDSRNFIGSKAGLPIDADANGAYNIARKGLWAINAIKSTADD MLDKVDLSISNAKWLEYVQK |
| SEQ ID NO: 587 | Cas12 variant | MADLSQFTHKYQVPKTLRFELIPQGKTLENLSAYGMVADDKQRSENYKK LKPVIDRIYKYFIEESLKNTNLDWNPLYEAIREYRKEKTTATITNLKEQQDI CRRAIASRFEGKVPDKGDKSVKDFNKKQSKLFKELFGKELFTDSVLEQLP GVSLSDEDKALLSFDKFTTYFVGFYDNRKNVFSSDDISTGIPHRLVQENF PKFIDNCDDYKRLVLVAPELKEKLEKAAEATKIFEDVSLDEIFSIKFYNRLL QQNQIDQFNQLLGGIAGAPGTPKIQGLNETLNLSMQQDKTLEQKLKSVPH RFSPLYKQILSDRSSLSFIPESFSCDAEVLLAVQEYLDNLKTEHVIEDLKEV FNRLTTLDLKHIYVNSTKVTAFSQALFGDWNLCREQLRVYKMSNGNEKI TKKALGELESWLKNSDIAFTELQEALADEALPAKVNLKVQEAISGLNEQM AKSLPKELKIPEEKEELKALLDAIQEVYHTLEWFIVSDDVETDTDFYVPLK ETLQIIQPIIPLYNKVRNFATQKPYSVEKFKLNFANPTLADGWDENKEQQN CAVLFQKGNNYYLGILNPKNKPDFDNVDTEKQGNCYQKMVYKQFPDFS KMMPKCTTQLKEVKQHFEGKDSDYILNNKNFIKPLTITREVYDLNNVLYD GKKKFQIDYLRKTKDEDGYYTALHTWIDFAKKFVASYKSTSIYDTSTILPP EKYEKLNEFYGALDNLFYQIKFENIPEEIIDTYVEDGKLFLFQIYNKDFAAG ATGAPNLHTIYWKAVFDPENVKDVVVKLNGQAELFYRPKSNMDVIRHK VGEKLVNRTLKDGSILTDELHKELYLYANGSLKKGLSEDAKIILDKNLAVI YDVHHEIVKDRRFTTDKFFFHVPLTLNYKCDKNPVKFNAEVQEYLKENP DTYVIGIDRGERNLIYAVVIDPKGRIVEQKSFNVINGFDYHGKLDQREKER VKARQAWTAVGKIKELKQGYLSLVVHEISKMMVRYQAVVVLENLNVGF KRVRSGIAEKAVYQQFEKMLINKLNYLMFKDAGGTEPGSVLNAYQLTDR FESFAKMGLQTGFLFYIPAAFTSKIDPATGFVDPFRWGAIKTLADKREFLS GFESLKFDSTTGNFILHFDVSKNKNFQKKLEGFVPDWDIIIEANKMKTGKG ATYIAGKRIEFVRDNNSQGHYEDYLPCNALAETLRQCDIPYEEGKDILPLIL EKNDSKLLHSVFKVVRLTLQMRNSNAETGEDYISSPVEDVSGSCFDSRME NEKLPKDADANGAYHIALKGMLALERLRKDEKMAISNNDWLNYIQEKR A |
| SEQ ID NO: 588 | Cas12 variant | MTNFDNFTKKYVNSKTIRLEAIPVGKTLKNIEKMGFIAADRQRDEDYQKA KSVIDHIYKAFMDDCLKDLFLDWDPLYEAVVACWRERSPEGRQALQIMQ ADYRKKIADRFRNHELYGSLFTKKIFDGSVAQRLPDLEQSAEEKSLLSNFN KFTSYFRDFFDKRKRLFSDDEKHSAIAYRLINENFLKFVANCEAFRRMTER VPELREKLQNTGSLQVYNGLALDEVFSADFYNQLIVQKQIDLYNQLIGGIA GEPGTPNIQGLNATINLALQGDSSLHEKLAGIPHRFNPLYKQILSDVSTLSF VPSSAFQSDGEMLAAVRGFKVQLESGRVLQNVRRLFNGLETEADLSRVYV NNSKLAAFSSMFFGRWNLCSDALFAWKKGKQKKITNKKLTEIKKWLKNS DIAIAEIQEAFGEDFPRGKINEKIQAQADALHSQLALPIPENLKALCAKDGL KSMLDTVLGLYRMLQWFIVGDDNEKDSDFYFGLGKILGSLDPVLVLYNR VRNYITKKPYSLTKFRLNFDNSQLLNGWDENNLDTNCASIFIKDGKYYLG ISNKNNRPQFDTVATSGKSGYQRMVYKQFANWGRDLPHSTTQMKKVKK HFSASDADYVLDGDKFIRPLIITKEIFDLNNVKFNGKKKLQVDYLRNTGD REGYTHALHTWINFAKDFCACYKSTSIYDISCLRPTDQYDNLMDFYADLG NLSHRIVWQTIPEEAIDNYVEQGQLFLFQLYNKDFAPGADGKPNLHTLYW KAVFNPENLEDVVVKLNGKAELFYRPRSNMDVVRHKVGEKLVNRKLKN GLTLPSRLHEEIYRYVNGTLNKDLSADARSVLPLAVVRDVQHEIIKDRRFT ADKFFFHASLTFNPFKSSDKPVGFNEDVREYLREHPDTYVVGVDRGERNLI YIVVIDPQGNIVEQRSFNMINGIDYWSLLDQKEKERVEAKQAWETVGKIK DLKCCGYLSFLIHEITKIIIKYHAVVILENLSLGFKRVRTGIAEKAVYQQFER MLVTKLGYVVFKDRAGKAPGGVLNAYQLTDNTRTAENTGIQNGFLFYVP AAFTSRVDPATGFFDFYDWGKIKTATDKKNFIAGFNSVRYERSTGDFIVH VGAKNLAVRRVAEDVRTEWDIVIEANVRKMGIDGNSYISGKRIRYRSGEQ GHGQYENHLPCQELIRALQQYGIQYETGKDILPAILQQDDAKLTDTVFDV FRLALQMRNTSAETGEDYFNSVVRDSGRCFDTRRAEAAMPKEADAND AYHIALKGLFVLEKLRKGESIGIKNTEWLRYVQQRHS |
| SEQ ID NO: 589 | Cas12 variant | MENYGGFTGLYPLQKTLKFELRPQGRTMEHLVSSNFFEEDRDRAEKYKIV KKVIDNYHKDFINECLSKRSFDWTPLMKTSEKYYASKEKNGKKKQDLDQ KIIPTIENLSEKDRKELELEQKRMRKEIVSVFKEDKRFKYLFSEKLFSILLKD EDYSKEKLTEKEILALKSFNKFSGYFIGLHKNRANFYSEGDESTAIAYRIV NENFPKFLSNLKKYREVCEKYPEIIQDAEQSLAGLNIKMDDIFPMENFNKV MTQDGIDLYNLAIGGKAQALGEKQKGLNEFLNEVNQSYKKGNDRIRMTP LFKQILSERTSYSYILDAFDDNSQLITSINGFFTEVEKDKEGNTFDRAVGLI |

TABLE 1-continued

Cas12 Sequences

| SEQ ID NO | Description | Sequence |
|---|---|---|
| | | ASYMKYDLSRVYIRKADLNKVSMEIFGSWERLGGLLRIFKSELYGDVNAE<br>KTSKKVDKWLNSGEFSLSDVINAIAGSKSAETFDEYILKMRVARGEIDNA<br>LEKIKCINGNFSEDENSKMIIKAILDSVQRLFHLFSSFQVRADFSQDGDFYA<br>EYNEIYEKLFAIVPLYNRVRNYLTKNNLSMKKIKLNFKNPALANGWDLN<br>KEYDNTAVIFLREGKYYLGIMNPSKKKNIKFEEGSGTGPFYKKMAYKLLP<br>DPNKMLPKVFFAKKNINYYNPSDEIVKGYKAGKYKKGENFDIDFCHKLID<br>FFKESIQKNEDWRAFNYLFSATESYKDISDFYSEVEDQGYRMYFLNVPVA<br>NIDEYVEKGDLFLFQIYNKDFASGAKGNKDMHTIYWNAAFSDENLRNVV<br>VKLNGEAELFYRDKSIIEPICHKKGEMLVNRTCFDKTPVPDKIHKELFDYH<br>NGRAKTLSIEAKGYLDRVGVFQASYEIIKDRRYSENKMYFHVPLKLNFKA<br>DGKKNLNKMVIEKFLSDKDVHIIGIDRGERNLLYYSVIDRRGNIIDQDSLNI<br>IDGFDYQKKLGQREIERREARQSWNSIGKIKDLKEGYLSKAVHKVSKMVL<br>EYNAIVVLEDLNFGFKRGRFKVEKQVYQKFEKMLIDKLNYLVFKEVLDS<br>RDAGGVLNAYQLTTQLESFNKLGKQSGILFYVPAAYTSKIDPTTGFVSLFN<br>TSRIESDSEKKDFLSGFDSIVYSAKDGGIFAFKFDYRNRNFQREKTDHKNI<br>WTVYTNGDRIKYKGRMKGYEITSPTKRIKDVLSSSGIRYDDGQELRDSHQ<br>SGNKVLINEVYNSFIDTLQMRNSDGEQDYIISPVKNRNGEFFRTDPDRREL<br>PVDADANGAYHIALRGELLMQKIAEDFDPKSDKFTMPKMEHKDWFEFM<br>QTRGD |
| SEQ ID NO: 590 | Cas12 variant | MLHAFTNQYQLSKTLRFGATLKEDEKKCKSHEELKGFVDISYENMKSSA<br>TIAESLNENELVKKCERCYSEIVKFHNAWEKIYYRTDQIAVYKDFYRQLS<br>RKARFDAGKQNSQLITLASLCGMYQGAKLSRYITNYWKDNITRQKSFLK<br>DFSQQLHQYTRALEKSDKAHTKPNLINFNKTFMVLANLVNEIVIPLSNGAI<br>SFPNISKLEDGEESHLIEFALNDYSQLSELIGELKDAIATNGGYTPFAKVTL<br>NHYTAEQKPHVFKNDIDAKIRELKLIGLVETLKGKSSEQIEEYFSNLDKFST<br>YNDRNQSVIVRTQCFKYKPIPFLVKHQLAKYISEPNGWDEDAVAKVLDA<br>VGAIRSPAHDYANNQEGFDLNHYPIKVAFDYAWEQLANSLYTTVTFPQE<br>MCEKYLNSIYGCEVSKEPVFKFYADLLYIRKNLAVLEHKNNLPSNQEEFIC<br>KINNTFENIVLPYKISQFETYKKDILAWINDGHDHKKYTDAKQQLGFIRGG<br>LKGRIKAEEVSQKDKYGKIKSYYENPYTKLTNEFKQISSTYGKTFAELRD<br>KFKEKNEITKITHFGHIEDKNRDRYLLASELKHEQINHVSTILNKLDKSSEFI<br>TYQVKSLTSKTLIKLIKNHTTKKGAISPYADFHTSKTGPFNKNEIEKNWDNY<br>KREQVLVEYVKDCLTDSTMAKNQNWAEFGWNFEKCNSYEDIEHEIDQKS<br>YLLQSDTISKQSIASLVEGGCLLLPIINQDITSKERKDKNQFSKDWNHIFEG<br>SKEFRLHPEFAVSYRTPIEGYPVQKRYGRLQFVCAFNAHIVPQNGEFINLK<br>KQIENFNDEDVQKRNVTEFNKKVNHALSDKEYVVIGIDRGLKQLATLCVL<br>DKRGKILGDFEIYKKEFVRAEKRSESHWEHTQAETRHILDLSNLRVETTIE<br>GKKVLVDQSLTLVKKNRDTPDEEATEENKQIKLKQLSYIRKLQHKMQT<br>NEQDVLDLINNEPSDEEFKKRIEGLISSFGEGQKYADLPINTMREMISDLQ<br>GVIARGNNQTEKNKIIELDAADNLKQGIVANMIGIVNYIFAKYSYKAYISL<br>EDLSRAYGGAKSGYDGRYLPSTSQDEDVDFKEQQNQMLAGLGTYQFFE<br>MQLLKKLQKIQSDNTVLRFVPAFRSADNYRNILRLEETKYKSKPFGVVHFI<br>DPKFTSKKCPVCSKTNVYRDKDDILVCKECGFRSDSQLKERENNIHYIHN<br>GDDDNGAYHIALKSVENLIQMK |
| SEQ ID NO: 591 | Cas12 variant | MKNGINLFKTKTTKTKGVDMEKYQITKTIRFKLLPDNAHEIVEKVKSLKT<br>SNVDELMDEVKNVHLKGLELLFALKKYFYFDGNQCKSFKSTLEIKARWL<br>RLYTPDQYYLKKSSKNSYQLKSLSYFKDVFNDWLFNWEESVSELAIIYEK<br>YKICQHQRDSRADIALLIKKLSMKEYFPPISDLIDCVNDKNSNKTFLMKLS<br>EELSVLLEKCNSRALPYQSNGIVVGKASLNYYTVSKSEKMLQNEYEDVC<br>QSLDKNYDITEMKVILYKEKLDNLNFKDVTIANAYNLLKENKALQKRLFS<br>EYVSQGKVLSLIKTELPLFSNINDNDFEKYKEWSNEIKKLADKKNTFCKKT<br>QQDKIKDIQNKISELKKKRGALFQYKFTSFQKHCDNYKKVAVQYGKLKA<br>RKKAIEKDEIEANLLRYWSVILEQEDKHSLVLIPKNNAKDAKQYIETINTK<br>GGKYIIHHLDSLTLRALNKLCFNAVDIEKGKQMVRENTFYQGIKEEFERNKI<br>NCDNQGVLKIQGLYSFKTEGGQINEKEAVEFFKEVLKSNYAREVLNLPYD<br>LESNIFQKEYTNLDQFRQDLEKCCYALHSKIGKDDLDEFTRRFEAQVFDIT<br>SIDLKSKKEKTKTTGEMKKHTQLWLEFWKGAIEQNFATRVNPELSIFWRA<br>PKSSREKKYGKGSDLYDPNKNNRYLYEQYTLALTITENAGSHFKDIAFKD<br>TSKIKEAIKEFNMSLSQSKYCFGIDRGNAELVSLCLIKNEKDFPFEKFPVYR<br>LRDLTYQGDFKDKHDQMRYGVAIKNISYFIDQEDLFEKNNLSAIDMTTAK<br>LIKNKIVLNGDVLTYLKLKEETAHKLTQFFQGSSINKNSRVYFDEDENVF<br>KITTNRNHNPEEIIYFYRGEYGAIKNKNDLEDILNEYLCKMETGESEIVLLN<br>RVNHLRDAISANIVGILSYLIDLFPETIVALENLAKGTIDRHVSQSYENITRR<br>FEWALYRKLLNKQLAPPELKENILLREGDDKIDQFGHHFVEEKNTSKDCP<br>NCRKTTQQTNDNKFKEKKFVCKSCGFDTSKDRKGMDSLNSPDTVAAYN<br>VARKKFES |
| SEQ ID NO: 592 | Cas12 variant | MAKETKEFKTFDDFTNLYEVQKTLRFELEAVPETEIVLENRGIWYKRDKK<br>RADEKPIVKFYMDILHREFTDEALEKIKESGVLNLSGYPKLFEELRRLQNH<br>GANTKEEKKLKLEEIRAKKREISNELSQIRRVFSVRGFDVVDSDWKKKYTI<br>EGKKIKNDKSKTYLILSENILNFLENRFTSKEVERLRSIDKKHVEDYGNVV<br>NSGGENIFATFKGFFGYFDSLIKNRENFYETDGKAGRVATRSVDENLNFF |

TABLE 1-continued

Cas12 Sequences

| SEQ ID NO | Description | Sequence |
|---|---|---|
| | | AENLHIFSTDLPKALKDDLSDTQKAIFERSYYKNCLLQKDIKSYNLIIGDIN KEINKHRQQRDTKIKFLNTLFKQILSIEEKEQYKHIEINNDEDLIRAIRDFISL NESKISEGTKIFNQFIQRCLQKEDLGQIYLPKDSVNTIAHRIFKPWDEIMAL FDRKYFVSLEEIKDLTESSVWKERVLEESKTKSLIFKDTHIHTIISGQEIFSN FILILEKEYKNQFSGFISETRRGKAAFVGYDESLKNLRATIKWFEGKNLKL SETEKVEWIKAIKDYADAALRIFQMTKYLWLPVVGDEEDKDYLRIKAEID QLTKDNDFYNKINAFIDGYKPEPFIYRSSFQEYLTRRPFSTDKFKINFENSR LLDGWDKDMIDDRMGILLQRDGDYFLGILNKEDRHCLDNLVDVKSEDK NSYALMQFKQLTGLYRQLPRMAFPKKKQPVLEANAEIKKIKEDFDFLQK QKKEREVNVNVVFDNKKLNLLINHYAEFLKENYKDEKCYDFSLLNKEKV YESLSDFYADVDKITYSLSFIQVSIDQLIKTGKILLFRLKNKDLLKGSLGQN KNLHTYYFHALFERENLSQGRIRLGAQAEIFFRPASIEKEKDKNRSNALKK SPKTRYVKEILKNKRYSEDKVFLHLPIQLNADAYDLPSINQNVFEFIKNRQ EKVKIIGIDRGEKNLAYYSVISQNSNGKIKIEEPPRDLNLGYLEPLDELENK RQDERKAWQSISEIKSKRDGYISYAVSKIVELMLKYQAIIVLEDLSGKFKR SRMKFEKAPYQQLELALIKKLNYLVKKNSKSGKPGHYLSAYQLTEPVGS YKEMGKQTGIIFYTQAGYTSRTCPTCGWRKRVQGLYYKDRTSAQRRFDP KTGVKIFYDSVNDRFVFQYHPVYEQKELKEWDKEIYSDVTRIRWNNEEK KNNEYRKGDITLKIKRLFRDRGIDLSRNINEQLVNVGDASFWEELINLLRLI TEIRNIDNENNRDFIECPHCHFQSENGFHGVAWNGDANGAYNIARKGLLI TKAVCDPEKNVGDITWSDLKVDMKDWDAATDEWAKKNPEK |
| SEQ ID NO: 593 | Cas12 variant | MENEKIFSDLTNRYQVVKTLPFELKPVPRTRVLLGLDNPNKGEIFSKDRER AENFTIIKKYIDRLHSLFINESLKKADIDFSNFYKQYGKNINTKNNKNIDDD NDINDDEKEDSENDNLKKYRQEIANLFNKSKYKSWVNVGKDGDKISGML FEKGLIDLLRTHFSDNLNEDIEIPELFSNKKIKDTRKLKEIINSFGKDGKDGQ NFTTYFSVSFHNNRKNYYKSDGKMGRVSTRIVDENLERFCKNIYLYKEIIG KNEIKEIFSGNWDIYLQKKPNFSNDKTYKKLDEFKNDKYDWEMIFRDVNS YNKYFLQSDIEFYNYIRGKLNQDINEYNGKKRDSKEKINSQFENLRNQVH GEKKNYDDDFEIDEDNIIQFINEIFVRHNQNKMRFSEKLFSDFIDLLMVDN GDKLDKVYFSQKAVENAIARYYFVEETTNEGREPLLISLLLQNAGKDRKK LSNKPIKLGDIKFVLDQANNKPAEDIFKNRYVLSESNNDGIINANDKNHW ANLLRLIKKDFYFHKDNLIKSQDKLALETKYNKGSDEGERQIETIKNFAES AKAILRMTKYFDLRKNGVIQNVIGGKDPIHEEVDKYFDGDVLSGEESCRIS KYYDALRNFITKKAWSADKIILNFDCSEFLGGWDRSQEQKKRGIILRHRD GDEERYYLAVLGKNGKQYFENRTLFKGCESSDWQKIEYNVIQKPHMSLP KNLITPFFKKDKITNERFIDRSKKGAKALIEIDINPSDEFLNNYNLGKHTKE NLDKSFLCDYFKYLMDAIAKYYKGEFNFNFPDVSNFDNTQPFYSFIEKNA YSIKYFGISSKEIEKLIADCYYKEDVYLFQIYCKDFEIDPKIGKAKYGNEFR TKAEIRKSKGEEAGNENLNTKYFKLLFDEKNLKNQNGIVVYKLNGGAKMF YRPSSIKKDEKIDGKWRYKEDKYSLNITITCNFSSKKDDLSIDKDINKKIAE VNANSDFRIISIDRGEKNLAYCCVMDENANILDIKSLNRITRYDKNGKAIK EKNMFHEVKDGKLCYGEPVYDFYKDYQNLLDEREIKRLVNRRSWNVIED IKNLKKGYVALLINYICKAVVIAINEGKYPIIVLESLDKGMLHNRVKIEKQI YRGVEEGLVRKLNYFVDKKTDNVLNAWQLLAKFETVGSSLDRKKQLGII FYVDPGYTSITCPCCGFRQRKYIKAERAEENFKEIKIKPFDGKRYSFAYDYR CIDDNGKEKSKEDITYSNVKRURSGRNGRAVQIEDVTDELTNLFKKHNIN IEQDINEQLAGKDNKFWKQLLWWFNAIEQIRNTQSLRRKFNTEENKLEILE NNDCDFILCPHCYFDSNKDKFQNKIWNGDANGAFNIGRKGIIDIFEIKKHQ RMLSDFMEQWGIDKLPKANGGNQAVIEIVKNDKKYNLCILNNKKIPYYC LRIGKEKIDSIADDRKCNQLPDLMVNWKKWDMWLDKWGK |
| SEQ ID NO: 594 | Cas12 variant | MPEVKNVFQDFTNLYELSKTLRFELKPVPETEKILELNAAKTKKFPKDLY RAENFEIIKKYTDELHRTYIRETLNNVNIDYLKFLEIFRINGKKKNEMTDEN EESDENNEKDDIQKIKKELRSKIGNLFNKWNNDKDNKFKDWVKIDVGKK EKEVSGDLFGKELITILKNYFKNKLDSKVNVPMLFFNEQEIKNGEAKKQR KLEAVFENFDKFTTYFTDSFYNNRKNYYKTEGRVGQVATRIIDENLPRFC SNLIAFNEVVSLYSTLLNNFDLGWKEYLNEKKINQTWVEKFELSNYDWK ALFNDVNYYNQCLLQEGIDKYNYIIKKLNKDINEYTQNKYKSVEKGNNN NPDINFFQKLHKQIHGERDFKLIEIDIDENNIFTKILPEFILHSDMKLMTKID EEVGVEEIVGAERIIKIFIKQELKDLEKIYLSRRAIETISAKWFHSWETLKDL ILGYLNKDLLESKKRKKVPDFVDFNIIKIVLENNKDDYKDLFKRKYFEAD KNEFVDWIDSSGGTKKLEFGGENWINFLNVFEYEFGTLLTEYKKNKNALL YLIDKKIDYDKNNEVGQTAAIKNFADSALGIFRMVSYFALRKKGVMVEP KNGKDEIFYAFVDRYLDGDDNDREEQNKIVQYYNTLRNFVTQKAWSIDK VRLCFDCGEFLKGWDKDKIHERLGHLRNNNKFYLGILNKNHKQIFIKIKSH DNNNFYYVIDYKQLNNVYRQIPRLAFPSRSVKKGDAYMLRAIQERKKK FFLEDEEFIELQEIKNEYDKIGNDLSKEKLTKLIEYYKKVVISNYSSLYNVS NLNNKKFNSINEFNQYVENLMYSLIPTRISPDFIKEKISKGELYLFQIYNKD FELDESIGKEKFGEDFAPVIMDGKNNLHTEYFKLLFNDSNLKNPNGVVFK LSGGAKMFYRPATENLPIKKDRDGNIIKNKKGENVIVGQRYKEDKYFLHL PIILNFVNKGKNYSINDMVNKAITNASDDQDKFRIIGLDRGEKHLVYYSVI NERQEIIEIGSLNNISRKDNKGEIIEEKNWYHDKFGNIEKEPTKEYHKDYHN LLDQREIERLKSRQSWEKIENIKELKEGYISAVINKICNLVIKAIKENKIPIV |

TABLE 1-continued

Cas12 Sequences

| SEQ ID NO | Description | Sequence |
|---|---|---|
| | | ALENLNSGMKRGRIKIDKQIYQKLELKLAKKLNFLVDKKEKNYLSAWQF TPKIETFSGDIEKKNQVGIIFYVDPAFTSATCPNCGFRKRIKMDPQNAKKKI KDMEITYENGIYKFDYPIENGENDVVYSDVERLKWDNEKKKVIKTKNVS DDFGKLFEDIKDKNNLKKELLSIGEENKEFWKEFSRCFNLLLRIRNSKLIK RKLNDDTGKVEIIADDDLADRDRDFIYCPQCHFHSEGGDVFGEFVKKKYL GKDNFEFNGDANGAYNIARKTHAVNKIKDYQLGLNHFIEKYRISELPNNG KDKKNIFYNNNSYILSFFEVQDEKFRKVKVYGLKKDGDRQIIQKKEMWY RRYPDIFVNNKEWDKFVQNKS |
| SEQ ID NO: 595 | Cas12 variant | MLFFMSTDITNKPREKGVFDNFTNLYEFSKTLTFGLIPLKWDDNKKMIVE DEDFSVLRKYGVIEEDKRIAESIKIAKFYLNILHRELIGKVLGSLKFEKKNL ENYDRLLGEIEKNNKNENISEDKKKEIRKNFKKELSIAQDILLKKVGEVFE SNGSGILSSKNCLDELTKRFTRQEVDKLRRENKDIGVEYPDVAYREKDGK EETKSFFAMDVGYLDDFHKNRKQLYSVKGKKNSLGRRILDNFEIFCKNK KLYEKYKNLDIDFSEIERNFNLTLEKVFDFDNYNERLTQEGLDEYAKILGG ESNKQERTANIHGLNQIIINLYIQKKQSEQKAEQKETGKKKIKFNKKDYPTF TCLQKQILSQVFRKEHIESDRDLIRELKFFVEESKEKVDKARGIIEFLLNHEE NDIDLAMVYLPKSKINSFVYKVFKEPQDFLSVFQDGASNLDFVSFDKIKTH LENNKLTYKIFFKTLIKENHDFESFLILLQQEIDLLIDGGETVTLGGKKESIT SLDEKKNRLKEKLGWFEGKVRENEKMKDEEEGEFCSTVLAYSQAVLNIT KRAEIFWLNEKQDAKVGEDNKDMIFYKKFPDEFADDGFAPFFYFDKFGNY LKRRSRNTTKEIKLHFGNDDLLEGWDMNKEPEYWSFILRDRNQYYLGIG KKDGEIFHKKLGNSVEAVKEAYELENEADFYEKIDYKQLNIDRFEGIAPFK KTKTEEAFRQVCKKRADEFLGGDTYEFKILLAIKKEYDDFKARRQKEKD WDSKFSKEKMSKLIEYYITCLGKRDDWKRFNLNFRQPKEYEDRSDFVRHI QRQAYWIDPRKVSKDYVDKKVAEGEMFLFKVHNKDFYDFERKSEDKKN HTANLFTQYLLELFSCENIKNIKSKDLIESIFELDGKAEIRFRPKTDDVKLKI YQKKGKDVTYADKRDGNKEKEVIQHRRFAKDALTLHLKIRLNFGKHVNL FDFNKLVNTELFAKVPVPKILGMDRGENNLIYYCFLDEHGEIENGKCGSLN RVGEQIITLEDDKKVKEPVDYFQLLVDREGQRDWEQKNWQKMTRIKDLK KAYLGNVVSWISKEMLSGIKEGVVTIGVLEDLSNFKRTRFFRERQVYQG FEKALVNKLGYLVDKKYDNYRNVYQFAPIVDSVEEMEKNKQIGTLVYVP ASYTSKICPHPKCGWRERLYMKNSASKEKIVGLLKSDGIKISYDQKNDRF YFEYQWEQEHKSDGKKKKYSGVDKVFSNVSRMRWDVEQKKSIDFVDGT DGSITNKLKSLLKGKGIELDNINQQIVNQQKELGVEFFQSIIFYFNLIMQIRN YDKEKSGSEADYIQCPSCLFDSRKPEMNGKLSAITNGDANGAYNIARKGF MQLCRIRENPQEPMKLITNREWDEAVREWDIYSAAQKIPVLSEEN |
| SEQ ID NO: 596 | Cas12 variant | MTIKKHKPFTNFECLTPVQKTLRFRLIPVGRTTEFVKCRNIIEADRKRSEM YPLLKELADRFYREFMTDQLSNLLFDWSPLVEALLLARNNTDPRENQRIA SLVRDEQKKYRTLLLKRLSGQVDRNGTPLPKNTASVNKKYYDDLFKARF VTETLPAYLEHLKNKPDGRISDELFDAYKDALDSYQKFTSRLTNFWQARK NIFTDEDIATGFAYRIVHEIVPDYLFNRRVYEQHKLDFPEPLDLLETELKKK NLIANDESLDALFTIPAINRLLTQKGVDLHNAVIGGFFTDDHTKVQGFNEL ANLKNQTLKNVSDNSEIKPVGKMTRLKKHILSISESTSFLFEQIESDDDLLA RIIEFNNTLSEPDIDGLSIADINDQLYNIMTGVDPSTILVHARNLNKLSHEAS LSWNRLRDGLYQMATESPYREDERFKRYIDASEEERDLSKLKNDIYFSLQ ELQFALDQSIDLEEEATPTEDIFLPFEFPPGMDLKSELTVLFRSIEQLISSETKL IGNPDAIATIKKYLDAIMARYSIWNLLSCEAVELQDDLFYPEYDRVMGSLS NIIILLYNLARNYLSRKPSSKEKFRLNFDKPTLADGWSESKVPDNFSVLLRK DDLFYLGILKDRKAYRVLSYENCDETAKNIKGYYERMIYHFSPDAYRMIP KCSTARKDVKKHFGEQGETTGYTLYPGASNFVKPFTIPYEIYRLQTELVN DKKRYQADYLKQTEDEEGYRQAVTAWIDFCKSYLESYEGTSTFDYSHLL KSEDYEDVNQFYADVDRASYSIYFEKVSVDLIHTMVDRGDLYLFQLYNK DFSPHSTGKPNLHTMYWRALFSNDNLQNNTIKLNGQAELFYRPKQVEQP TVHLQGSYLLNRFDKHGDVIPAGLYCEIYNHINERHPEGYTLSEEATQGLL DGRFVYREAPFELVKDKRYTEDQLFLHVPLEFNWTASANVPFENLANEYI KKDSDLHIIGIDRGERNLLYYSVINLQGDIVKQGSLNTLIQQTTLKGETVER QIPYQSMLKQREDERAEARQNWQSIDRIKDLKEGYLSHVIYKLSRLIIKYH AIVVMENLNVGFKRGRFKVERQVYQKFEVALINKLNALSFKEYEPNELG GVMRPWQLARRVVSPEDTRSQNGIVFYVPASYTSIVDPVTGFANLFYLNR IRNKDLNSFYGHFQEIRYDHEFDRFIFRFNYADFGVFCRIKNVPSRTWNLV SGERKAFNPKRRMIEKRDTTDEIKKALEAHGIAYQNEQNLLPLLLENENLL ARIHRSFRLVLQLRNSDSRDDIVSPALDKENNTFDSGQQPYESSLPINAD ANGAYNIARKGLLLVDKVKNDKRAVLSNREWFEYLMAEE |
| SEQ ID NO: 597 | Cas12 variant | MENKDYSLSRFTKQYQNSKTVRFALTPIGRTEEYIIQNQYIEAARRKNQA YKIVKPIIDEKFRSMIDDVLTHCEKQDWVTLDKLILQYQNNKCRENMDAL AEQQEEIRKNISEEFTKSDEYKNPFFGKEDSKKLFKIFLPEYLNQINASESDK EAVNEFQKFKTYFSNFLIVRADIFKADNKHNTIPYRIVNENFMIFAGNKRT FSNIIRLIPNALEEIAKDGMKKEEWSFYNIQNVDSWFEPDSFQMCMSQKGI QKYNFIIGLVNSYINLYTQQNPATEVKRSLKLRMLHKQILSDRVNPSW LPEQFKEGEEGEKQIYEAILALENDLIKNCFDKKYDLWIQSIDIQNPRIYIA ASEMARVSSALHMGWNGLNDVRKTILLKSDKKQAKVEKILKQDVSLKD |

TABLE 1-continued

Cas12 Sequences

| SEQ ID NO | Description | Sequence |
|---|---|---|
| | | LSDTLNRYADIYKEEQIPSLYQYIEYGSELLQDCAITRKEYHDLLNGNSNT LSLNQNEKLIEGLKAYLDSYQAIVHFLNVFIVGDELDKDTDFYAELDGLV ESLSEIVPLYNKVRNYITRKVYSLDKMRIMFERSDFLGGWGQSFDTKEAL LFQKDNLYYIGHEKKYTNMDVEYLHEGIKEGNRAIRFIYNFQKADNKNIP RTFIRSKGTNYAPAVRKYNLPIESIIDIYDVGKFKTNYKKINEKEYYESLEK LIDYFKDGILKNENYKKFHFNWKPSNEYENINEFYNDTNNACFLLEKEEIN YDHLKEQANQGKIYLFQISSKDFNEGSKGTPNLQTMYWRELFSNQNCKD GVIKLCGGASIYMRDASIKQPVVHRKNAWLINKWYKVNGQNVVIPDNTY VKFTKIAQERMNEDELTPQERQLWNSGLIQKKKATHDIMKDRRFTKKQY MLHAPLTINYKQQDSPRYFNEKVRSFLKDNPDINIIGIDRGEKNLIYITIIDQ KGNILKGMQKSFNQIEEKGKEGRTIDYYSKLESVEARHDAARKNWKQIG TIRELKEGYLSQVVHEITQLMIQYNAVIVMENLNMGFKKGRMKVEKSVY QKFEKMLIDKMNYLAFKRDMQGNAIDPYEVGGVMNGYQLTDRFTSFAD MGSQNGFIFYVPAAYTSVIDPVTGFVNVFQKTEFKTNDFLHRFDSISWND KEQSFVFTFDYQNFKCNGTCYQNKWSLYADVDRIETIIKNNQVDRIEPCN PNQKLIDFFDKKGITYRDGHNIVDDLEKYDSKTISEIIHNFKLILQLRNSMR NPDTGEIIDYIASPVMHNEERFDSRKRNPELPQDADANGAYHIALKGLMF LQKINEYADSDGNMDNRKLKITNEEWFKYMQTRKEHTYF |
| SEQ ID NO: 598 | Cas12 variant | MSNKTSSITTTNKLSYTGFHNNGKQSKTLMFELKPIGRTTEHLDRKGYLA DDDIDRAESYKTFKEIADNFHKNLIEESLATFTFSDTLKDYFDLWLSPVRTN EDTPKLRKMEAKLRKELSSALKQHPSFAATSSGKRLIDEALYPNASDKER QCLDRFKGRSSYLDSYTEVRSFIYTDLCKHNTIAYRVVNENLKIYLENILA YEKLMQTAVNGKLETVKEMFHDLYPTFSMDISIFFTSYGFDYCLSQNAIT RYNILLGGWSDDNGIHHKGLNNYINEYNQTVPRNKRLPKLNKLQKMILSE ENSMSFIIDKFENDVDLANAIRYWLKNCQFDALNLLIWTLDVHYNLDEIH FKNDNQGKNISDLSQALFKNHHVIRDAWDYDYDIVNAKAKSRQKPERYA EKRDKAFKKINSFSLSYLANILSQYDNQYANFVAQFKTRISVHIQNVQQMI ADKTLDMRLDPLMLLKSISSDTKLVEDIKRVLDSLKDMQRMLTPLLGEGT EPNRDAMFYSDFEPLMNYVDTLTPLYNKVRNYITKKPYSTKKTSLYFGAS NFGSGFDVTKLPVSHTIIMRDKGCYYLAVIDNNKLIDKLYDHNDNDGYEY MVYKQIPSPIKYFSLKNILPQDPPDDIRQLLEDRKNGAKWSHDDETRFIDYI VNEFLPTYPPIHDKNGNPYFSWKFKNPDEYESLNEFFDDVSKQAYQTSFR FVSRDFVDDAVENGDIFFFQIYNQDFSPASHGKPSPHTLWFRALFSDVNLE TKDIRLKGNATAYFRPASIFYTDEKWRKGHHYEQLKNKFKFPIIKDKRYA LDKFFFHITLEINCNATVEKYFNNRVNEEIRKADRYNILAINRGERNLLYA VVMDQDGTILEQKSFNIIKSELPNKTVKETDYWKKLHAREKERDTARKS WKSIECIKDLKKGYLSYVVKTITDMMFEYNAVLVMENLDIEMKRSRQKIE KNVYAQFQNAIIQKLSMYVNKDIDLHIARTAPGGTLNPYQLTYIPASRTKT PKQNGFVFFLNPWNITEIDPTTGFVDLFQTCFRTKNEYKDFFAKFKDIRYN EAQGWFEFDTDYTYFRDKEKAGKRTRWNICSYGTRLRRFRNPDKNYAED AMTVYPTQMLKDLFDEYNIPYAPASAKSTSISIKDDIIQIDKLDFYKKLLYI LKLIVQLRNTSPSSTEQEDDYIISPVINEDTNWFYDSRDYNEESLLPCNTDA NGAYSLALKCNMVIDRIKNTIPGEPVDMYISNADWLDARQ |
| SEQ ID NO: 599 | Cas12 variant | MNSKTSIFDFSNIFGRDITLRFKLTPVTINSKGEVKDANGADPYRPYLSADE ELQEQYELLKTAIDAYHQMYIDKKLKHILCLPLTEKGKDGVEHDTAKSKF VKSCLAYIKDYGEKDKKRQTADLRTFISRVFADDNISSLPPYKVKSDFITK TLRQWLEQPDTKVEKKEAILDLIEKNGSKLYANCQGLLEARQRLYEKDG KSTSVPYRCIDRNLPRFSKDYHLFEKILGDCSDVFDFEQLDKDFSEELKGIA RLSGIRVESVREVFQPLLYLAYLNQEGIQYLNTIIGTKKEKGTSALGLNEYI NQYNQKQGIKKKKDGIPMLNKLNNQILFGDEVFIETLAEHKEAIPVIKKVV SSLGKLGAFDGECHENKLYQFLLSLSSYAGNIYVNTKVVAQISSSLWGDY SILYDAVKHDKNGRLIQKSVTLGELNEKIERLKLEDNRDAFEYFRRSQVK DVVHGSSNVGVFEQLKNCYNDFVEKKILKCSFFSEDQVLVIQRLFDSILSL QRIFKVFCPSLYEVDSDGLFVAKFSDYWNVLRGFDKDYDLLRNLFKRKP YSTDKIRVHFGLSNLMDGFVDSWTDKKDKGTQYNGYILRQAHSFVDENT SKELQEFQRYNYYLVISGNVRLFREKGNALVCEKKKEKLVASDEFSGFER FDYYQSSINNFNREFKRLTGRDRKSFTDEILQNEGKKELKSTYIENLIKVA KSMKRLTALQNLVSDEKVRKYSENLDYETLSAEIGQILATGRERKYVPVS TNEMKNLLKSSKNNKGEEVRTFMFRISNKDLSYAETMQKGERKSHGAEN MHTMYFRALLDTLQNTFDIGTGTVYFRKASDKRKMKYDEKNPTHRKGD ELAFKNPYNKGKKKSVFGYDLIKDRRYTKDSYLFHLSITQNYQKKGNAE DLNAMVRDYIRTQEDLRVIGIDRGERNLLYATMIDGEGHILAQKSFNVIG YQGTTASGESFQVETDYHQLLNEKAEKMRSLQREWKEMDKIQDMKDGY LSVVVHELAKMVVENNAIIVMEDLNMGFMESRQSQLANVYQKFEEKLR NKLQFYVDKRKRNDEPSGLYHALQLAGTETKDNQNGFIFYIPAWNTSKID SVTGFVNLFNLKYTNIKDAKAFFSTFEKIEKNVETGHYDFTFSYSSMARK KMAKRMDGTRDSWTISTHGSRIVREQKGNYWEYREIESLTSEFDALFEKY SIDTRCRLKEAIDKCGEAEFFKELIRLMKWTLQLRNYDDRGNDYIVSPVC YRGNEYYCSLDYDNEEGMCISKIPCQMPKDADANGAFNIARKGLMLCER LKKGEKIGVIKGTEWLQYVQNMSERYVGMV |

TABLE 1-continued

Cas12 Sequences

| SEQ ID NO | Description | Sequence |
|---|---|---|
| SEQ ID NO: 600 | Cas12 variant | MINTMEQPKKSIWDEFTNLYSLQKTLRFELKPQGKTKELVRTLFINPEEHH HKLISDDLELSKNYKKVKKLIDCMHRNIINNVLSKHQFTGEELKKLDKNS NAEDNDTETDNADKKDPFAKIRERLTKALNEESKIMFDNKLLNPKKGKN KGECELKKWMDKAEDKYFELGNNEKIDKEAVKADMERLEGFFTYFGGF NKNRENVYSSKKIATAIPFRIIHDNFPIFKKNIENYKKITEKHPELAKLLNEK GANEIFQLEHFNKCLTQDGIDVYNNEKLGIIAKEQGKEQDKGINQLINEYA QKKNKEIKENAKGGEKPKKIKIAVFDKLKKQILSISKTKSFQFEVFEDTSDI INGINKRYTFLTEAKEGMSIVDEIKKIIGSVGDEKYSLDEIYLKEKFISTLSK KLFNYSRYIEVALEKWYDDRYDDKINKSGTDKRKFISAKQFSITSIQDAIN YYLEKYEKDEELSKKYTGKNIIVDYFKNPTITIEHKQKEEVISEEKDLFKEL EVRRNVIQHILNGDYKKDLKEEKQQDGDSEKVKAFLDALLEFNYILNPFII KDKNLRKEQEKDEEFYNEIKKLQESIFEAEILDLYNQTRNYITKKPYKLDK FKLTFGSGYFLSGWSNDMEEREGSILIKYNEDRSKNYYLIIMAKPLTDDDK KQLFSDNGTHSKICIYEFQKMDMKNFPRMFINSKGSNPAPAIEKYNLPIKTI WADYQKYKNLNQKGKDKFLEENPDFRHNLIGYFKICAEKHESLAPFKHQ FSSIWKPTKEYENLAQFYKDTLEACYNLKFENVNFDNISQLVSSGKLHLF KIHNKDFNPGSTGKKNLHTLYWEMLFDEKNLQDVIFKLSGGAELFYREAS ILKNKIIHKIGEKVLKKFFKLPDGKLEPVPAESIKNLSAYFRKELPEHELTEI DRKYIDNYSIIGKKDDKLGIMKDERFTVDKIQFPHCPITINFKSKNKNFINDD VLEYLHKRDDVHIIGLDRGERHLIYLTMINKDGKIVDNMQFSLNELQRRY KINGNEEIQKINYQKLLDTREVSRTEARRNWQTIENIKNLKEGYLSLIVHQ LAKLMIEKNAIVVMENLNYGFKDSRARVEKQIYQKFESILIKKLQYLVMD KNNLYDSGGVLSAYQLTNQEVPAYKYISKQNGFLFYVPPDYTSKIDPETG FINLLDTRYYSRKNAVALLNKFDKIYYDRDNKYFRFDFDYNSTDSNGNK NFDKLRVDISELTRTKWSVCSHPAKRSITVQINNKWVRQPINDVTDKLIKL FEDKQIGYESGKCLKDEILKVEDAKFFEDLLRYLSVLLALRHTYTENGVE YDLIISSVEKAPGSNEFFVSGKDNNLPANADANGAYNIARKGLWLLRKLD EIDNQELAIKKFNELKHAKEIKKNGEESKEDKGDRKRKKKWVSQWCPNK EWLAFAQSMQDVSEK |
| SEQ ID NO: 601 | Cas12 variant | MNNGTNNFQNFIGISSLQKTLRNALIPTETTQQFIVKNGIIKEDELRGENRQ ILKDIMDDYYRGFISETLSSIDDIDWTSLFEKMEIQLKNGDNKDTLIKEQTE YRKAIHKKFANDDRFKNMFSAKLISDILPEFVIHNNNYSASEKEEKTQVIK LFSRFATSFKDYFKNRANCFSADDISSSSCHRIVNDNAEIFFSNALVYRRIV KSLSNDDINKISGDMKDSLKEMSLEEIYSYEKYGEFITQEGISFYNDICGKV NSFMNLYCQKNKENKNLYKLQKLHKQILCIADTSYEVPYKFESDEEVYQS VNGFLDNISSKHIVERLRKIGDNYNGYNLDKIYIVSKFYESVSQKTYRDWE TINTALEIHYNNILPGNGKSKADKVKKAVKNDLQKSITEINELVSNYKLCS DDNIKAETYIHEISHILNNFEAQELKYNPEIHLVESELKASELKNVLDVIMN AFHWCSVFMTEELVDKDNNFYAELEEIYDEIYPVISLYNLVRNYVTQKPY STKKIKLNFGIPTLADGWSKSKEYSNNAHLMRDNLYYLGIFNAKNKPDKK IIEGNTSENKGDYKKMIYNLLPGPNKMIPKVFLSSKTGVETYKPSAYILEG YKQNKHIKSSKDFDITFCHDLIDYFKNCIAIHPEWKNFGFDFSDTSTYEDIS GFYREVELQGYKIDWTYISEKDIDLLQEKGQLYLFQIYNKDFSKKSTGND NLHTMYLKNLFSEENLKDIVLKLNGEAEIFFRKSSIKNPIIHKKGSILVNRT YEAAEEKDQFGNIQIVRKNIPENIYQELYKYFNDKSDKELSDEAAKLKNVV GHHEAATNIVKDYRYTYDKYFLHMPITINFKANKTGFINDRILQYIAKEKD LHVIGIDRGERNLIYVSVIDTCGNIVEQKSFNIVNGYDYQIKLKQQEGARQI ARKEWKEIGKIKEIKEGYLSLVIHEISKMVIKYNAIIAMEDLSYGFKKGRFK VERQVYQKFETMLINKLNYLVFKDISITENGGLLKGYQLTYIPDKLKNVG HQCGCIFYVPAAYTSKIDPTTGFVNIFKFKDLTVDAKREFIKKFDSIRYDSE KNLFCFTFDYNNFITQNTVMSKSSWSVYTYGVRIKRRFVNGRFSNESDTID ITKDMEKTLEMTDINWRDGHDLRQDIIDYEIVQHIFEIFRLTVQMRNSLSE LEDRDYDRLISPVLNENNIFYDSAKAGDALPKDADANGAYCIALKGLYEI KQITENWKEDGKFSRDKLKISNKDWFDFIQNKRYL |
| SEQ ID NO: 602 | Cas12 variant | MSNLNTFISPEFTGKIKMTKSLKVSMIPIGETEHWIAKHKVFEKDRELFDK NLKARPILDEFIKYTVSRALPNLLFDFEAYYLVKKDRTKARAFEKELAKT VTDLILKEMDELKSASLIDSADFVKTTLKKFAGTHDIPGLSRIEAIESLEAA SKLTALNGKFNTSRIAIINTLIPKRIIENFDIYLSNMEKIRNVYESGEFGFLFE RYPDTLLFMEPANYRTVCSPEAIEDYNRFISGYGDSTESWIKGFNQELSEA SNSSKSSNGGVRRYSLIKPLHKQHLFETKKFFTFASISSDDDVRELINSVKG STEDACLNALAFFSSSDPKTLFVKGSYLHTLSAFLYGSANSYILPERIKEGE KARLTAEYDSVAKKTKAVTTRYNVAMNNISKKINEKIFSLADIDAYCCDI SKRRSVREILLGIMQEMYAAVYGENGKWSNIEAEAVLDSKTKIWKAKNG AVAKAVNDYLTAILEIRKFIRPFALRMEELEELGLDTSSALDAGEITNTLFE AVRAQKLVHAYLTRNDADIALSTQVYFGGTQKAASWWNYETGDIQNR QIALAKKDGMYYFIGTFDERGSYSIEPASPGEDYYEMLDVKKGQDANKQI KKVLFSNKAIREHFADSSNDYVITTKVNSPITVRREIFDKYQAGEFKLTSQ KIRKGDLVGEKEMTYYREYMDLLFQMAKGYTEYSRFNMDTLLPIEEYDT ENDLLDDVNTNTIDYRWVRISAACIDDGVRNGDIFVFRAQTSSMYGKREN KKGYTGLFLELVSDENLLVTRGMSLNSAMSIYYRAKVHDAITVHKKGDV LVNKFTNARERIPENSYKAICAFYNSGKSIEELTIEDRDWLAKATTRICSGE IIKDRRYTKNQYSISISYNINRSVNNRKRVDLATIVDDTASAGRIISVTRGT |

TABLE 1-continued

Cas12 Sequences

| SEQ ID NO | Description | Sequence |
|---|---|---|
| | | KDLVYYTVIDDGGSVIEARSLNVINGINYAKMLAQISEERHDSNANFDIPK<br>RVETIKEAYCAFAVHEIISAALKHNALIVVELISDAIKDKYSLLDNQVFLKF<br>ENVLKNCLMSVKVKGARGMEPGSISNPLQLCNADDKSFRNGILYQIPSSYI<br>NICPVTGYADIIDYYNIVSAGDIRNFFVRFENIVYNKEKARFEFSFDLKNIPI<br>KLEKCPDRTKWTVLGRGEITTYDPLTKSNHYVFDAAQMLAETVSKEGLD<br>PCANIVEHIDELSAATLKKMFNTFRNIAKGIVSECDEVPVSYYKSPVIDEA<br>DIKNKSLDNKSISEIKCYNLDEKARYYLALAKSSSDGENKNRYVSSTAIEW<br>LNYIQEKRTHE |

Alternatively, the Type V CRISPR/Cas enzyme is a programmable Cas14 nuclease. A Cas14 protein of the present disclosure includes 3 partial RuvC domains (RuvC-I, RuvC-II, and RuvC-III, also referred to herein as subdomains) that are not contiguous with respect to the primary amino acid sequence of the Cas14 protein, but form a RuvC domain once the protein is produced and folds. A naturally occurring Cas14 protein functions as an endonuclease that catalyzes cleavage at a specific sequence in a target nucleic acid. A programmable Cas14 nuclease can be a Cas14a protein, a Cas14b protein, a Cas14c protein, a Cas14d protein, a Cas14e protein, a Cas14f protein, a Cas14g protein, a Cas14h protein, or a Cas14u protein. In some cases, a suitable Cas14 protein comprises an amino acid sequence having at least 50%, at least 55%, at least 60%, at least 65%, at least 70%, at least 75%, at least 80%, at least 85%, at least 90%, at least 92%, at least 95%, at least 97%, at least 98%, at least 99%, or 100%, amino acid sequence identity to any one of SEQ ID NO: 12-SEQ ID NO: 102.

TABLE 2

Cas14 Sequences

| SEQ ID NO | Sequence |
|---|---|
| SEQ ID NO: 12 | MEVQKTVMKTLSLRILRPLYSQEIEKEIKEEKERRKQAGGTGELDGGFYKKLEKKHSEM<br>FSFDRLNLLLNQLQREIAKVYNHAISELYIATIAQGNKSNKHYISSIVYNRAYGYFYNAY<br>IALGICSKVEANFRSNELLTQQSALPTAKSDNFPIVLHKQKGAEGEDGGFRISTEGSDLIF<br>EIPIPFYEYNGENRKEPYKWVKKGGQKPVLKLILSTFRRQRNKGWAKDEGTDAEIRKVT<br>EGKYQVSQIEINRGKKLGEHQKWFANFSIEQPIYERKPNRSIVGGLDVGIRSPLVCAINNS<br>FSRYSVDSNDVFKFSKQVFAFRRRLLSKNSLRKRGHGAAHKLEPITEMTEKNDKFRKKI<br>IERWAKEVTNFFVKNQVGIVQIEDLSTMKDREDHFFNQYLRGFWPYYQMQTLIENKLK<br>EYGIEVKRVQAKYTSQLCSNPNCRYWNNYFNFEYRKVNKFPKFKCEKCNLEISADYNA<br>ARNLSTPDIEKFVAKATKGINLPEK |
| SEQ ID NO: 13 | MEEAKTVSKTLSLRILRPLYSAEIEKEIKEEKERRKQGGKSGELDSGFYKKLEKKHTQM<br>FGWDKLNLMLSQLQRQIARVFNQSISELYIETVIQGKKSNKHYTSKIVYNRAYSVFYNA<br>YLALGITSKVEANFRSTELLMQKSSLPTAKSDNFPILLHKQKGVEGEEGGFKISADGNDL<br>IFEIPIPFYEYDSANKKEPFKWIKKGGQKPTIKLILSTFRRQRNKGWAKDEGTDAEIRKVI<br>EGKYQVSHIEINRGKKLGDHQKWFVNFTIEQPIYERKLDKNIIGGIDVGIKSPLVCAVNN<br>SFARYSVDSNDVLKFSKQAFAFRRRLLSKNSLKRSGHGSKNKLDPITRMTEKNDRFRKK<br>IIERWAKEVTNFFIKNQVGTVQIEDLSTMKDRQDNFFNQYLRGFWPYYQMQNLIENKL<br>KEYGIETKRIKARYTSQLCSNPSCRHWNSYFSFDHRKTNNFPKFKCEKCALEISADYNA<br>ARNISTPDIEKFVAKATKGINLPDKNENVILE |
| SEQ ID NO: 14 | MAKNTITKTLKLRIVRPYNSAEVEKIVADEKNNREKIALEKNKDKVKEACSKHLKVAA<br>YCTTQVERNACLFCKARKLDDKFYQKLRGQFPDAVFWQEISEIFRQLQKQAAEIYNQSL<br>IELYYEIFIKGKGIANASSVEHYLSDVCYTRAAELFKNAAIASGLRSKIKSNFRLKELKN<br>MKSGLPTTKSDNFPIPLVPKQKGGQYTGFEISNHNSDFIIKIPFGRWQVVKKEIDKYRPWEK<br>FDFEQVQKSPKPISLLLSTQRRKRNKGWSKDEGTEAEIKKVMNGDYQTSYIEVKRGSKI<br>GEKSAWMLNLSIDVPKIDKGVDPSIIGGIDVGVKSPLVCAINNAFSRYSISDNDLFHFNK<br>KMFARRRILLKKNRHKRAGHGAKNKLKPITILTEKSERFRKKLIERWACEIADFFIKNKV<br>GTVQMENLESMKRKEDSYFNIRLRGFWPYAEMQNKIEFKLKQYGIEIRKVAPNNTSKT<br>CSKCGHLNNYFNFEYRKKNKFPHFKCEKCNFKENADYNAALNISNPKLKSTKEEP |
| SEQ ID NO: 15 | MERQKVPQIRKIVRVVPLRILRPKYSDVIENALKKFKEKGDDTNTNDFWRAIRDRDTEF<br>FRKELNFSEDEINQLERDTLFRVGLDNRVLFSYFDFLQEKLMKDYNKIISKLFINRQSKSS<br>FENDLTDEEVEELIEKDVTPFYGAYIGKGIKSVIKSNLGGKFIKSVKIDRETKKVTKLTAI<br>NIGLMGLPVAKSDTFPIKIIKTNPDYITFQKSTKENLQKIEDYETGIEYGDLLVQITIPWFK<br>NENKDFSLIKTKEAIEYYKLNGVGKKDLLNINLVLTTYHIRKKKSWQIDGSSQSLVREM<br>ANGELEEKWKSFFDTFIKKYGDEGKSALVKRRVNKKSRAKGEKGRELNLDERIKRLYD<br>SIKAKSFPSEINLIPENYKWKLHFSIEIPPMVNDIDSNLYGGIDFGEQNIATLCVKNIEKDD<br>YDFLTIYGNDLLKHAQASYARRRIMRVQDEYKARGHGKSRKTKAQEDYSERMQKLRQ<br>KITERLVKQISDFFLWRNKFHMAVCSLRYEDLNTLYKGESVKAKRMRQFINKQQLFNGI<br>ERKLKDYNSEIYVNSRYPHYTSRLCSKCGKLNLYFDFLKFRTKNIIIRKNPDGSEIKYMPF |

TABLE 2-continued

Cas14 Sequences

| SEQ ID NO | Sequence |
|---|---|
| | FICEFCGWKQAGDKNASANIADKDYQDKLNKEKEFCNIRKPKSKKEDIGEENEEERDYS RRFNRNSFIYNSLKKDNKLNQEKLFDEWKNQLKRKIDGRNKFEPKEYKDRFSYLFAYY QEIIKNESES |
| SEQ ID NO: 16 | MVPTELITKTLQLRVIRPLYFEEIEKELAELKEQKEKEFEETNSLLLESKKIDAKSLKKLK RKARSSAAVEFWKIAKEKYPDILTKPEMEFIFSEMQKMMARFYNKSMTNIFIEMNNDEK VNPLSLISKASTEANQVIKCSSISSGLNRKIAGSINKTKFKQVRDGLISLPTARTETFPISFY KSTANKDEIPISKINLPSEEEADLTITLPFPFFEIKKEKKGQKAYSYFNIIEKSGRSNNKIDL LLSTHRRQRRKGWKEEGGTSAEIRRLMEGEFDKEWEIYLGEAEKSEKAKNDLIKNMTR GKLSKDIKEQLEDIQVKYFSDNNVESWNDLSKEQKQELSKLRKKKVEELKDWKHVKEI LKTRAKIGWVELKRGKRQRDRNKWFVNITITRPPFINKELDDTKFGGIDLGVKVPFVCA VHGSPARLIIKENEILQFNKMVSARNRQITKDSEQRKGRGKKNKFIKKEIFNERNELFRK KIIERWANQIVKFFEDQKCATVQIENLESFDRTSYK |
| SEQ ID NO: 17 | MKSDTKDKKIIIHQTKTLSLRIVKPQSIPMEEFTDLVRYHQMIIFPVYNNGAIDLYKKLFK AKIQKGNEARAIKYFMNKIVYAPIANTVKNSYIALGYSTKMQSSFSGKRLWDLRFGEAT PPTIKADFPLPFYNQSGFKVSSENGEFIIGIPFGQYTKKTVSDIEKKTSFAWDKFTLEDTTK KTLIELLLSTKTRKMNEGWKNNEGTEAEIKRVMDGTYQVTSLEILQRDDSWFVNFNIA YDSLKKQPDRDKIAGIHMGITRPLTAVIYNNKYRALSIYPNTVMHLTQKQLARIKEQRT NSKYATGGHGRNAKVTGTDTLSEAYRQRRKKIIEDWIASIVKFAINNEIGTIYLEDISNTN SFFAAREQKLIYLEDISNTNSFLSTYKYPISAISDTLQHKLEEKAIQVIRKKAYYVNQICSL CGHYNKGFTYQFRRKNKFPKMKCQGCLEATSTEFNAAANVANPDYEKLLIKHGLLQL KK |
| SEQ ID NO: 18 | MSTITRQVRLSPTPEQSRLLMAHCQQYISTVNVLVAAFDSEVLTGKVSTKDFRAALPSA VKNQALRDAQSVFKRSVELGCLPVLKKPHCQWNNQNWRVEGDQLILPICKDGKTQQE RFRCAAVALEGKAGILRIKKKRGKWIADLTVTQEDAPESSGSAIMGVDLGIKVPAVAHI GGKGTRFFGNGRSQRSMRRRFYARRKTLQKAKKLRAVRKSKGKEARWMKTINHQLSR QIVNHAHALGVGTIKIEALQGIRKGTTRKSRGAAARKNNRMTNTWSFSQLTLFITYKAQ RQGITVEQVDPAYTSQDCPACRARNGAQDRTYVCSECGWRGHRDTVGAINISRRAGLS GHRRGATGA |
| SEQ ID NO: 19 | MIAQKTIKIKLNPTKEQIIKLNSIIEEYIKVSNFTAKKIAEIQESFTDSGLTQGTCSECGKEK TYRKYHLLKKDNKLFCITCYKRKYSQFTLQKVEFQNKTGLRNVAKLPKTYYTNAIRFA SDTFSGFDEIIKKKQNRLNSIQNRLNFWKELLYNPSNRNEIKIKVVKYAPKTDTREHPHY YSEAEIKGRIKRLEKQLKKFKMPKYPEFTSETISLQRELYSWKNPDELKISSITDKNESMN YYGKEYLKRYIDLINSQTPQILLEKENNSFYLCFPITKNIEMPKIDDTFEPVGIDWGITRNI AVVSILDSKTKKPKFVKFYSAGYILGKRKHYKSLRKHFGQKKRQDKINKLGTKEDRFID SNIHKLAFLIVKEIRNHSNKPIILMENITDNREEAEKSMRQNILLHSVKSRLQNYIAYKAL WNNIPTNLVKPEHTSQICNRCGHQDRENRPKGSKLFKCVKCNYMSNADFNASINIARKF YIGEYEPFYKDNEKMKSGVNSISM |
| SEQ ID NO: 20 | LKLSEQENITTGVKFKLKLDKETSEGLNDYFDEYGKAINFAIKVIQKELAEDRFAGKVRL DENKKPLLNEDGKKIWDFPNEFCSCGKQVNRYVNGKSLCQECYKNKFTEYGIRKRMYS AKGRKAEQDINIKNSTNKISKTHFNYAIREAFILDKSIKKQRKERFRRLREMKKKLQEFIE IRDGNKILCPKIEKQRVERYIHPSWINKEKKLEDFRGYSMSNVLGKIKILDRNIKREEKSL KEKGQINFKARRLMLDKSVKFLNDNKISFTISKNLPKEYELDLPEKEKRLNWLKEKIKII KNQKPKYAYLLRKDDNFYLQYTLETEFNLKEDYSGIVGIDRGVSHIAVYTFVHNNGKN ERPLFLNSSEILRLKNLQKERDRFLRRKHNKKRKKSNMRNIEKKIQLILHNYSKQIVDFA KNKNAFIVFEKLEKPKKNRSKMSKKSQYKLSQFTFKKLSDLVDYKAKREGIKVLYISPE YTSKECSHCGEKVNTQRPFNGNSSLFKCNKCGVELNADYNASINIAKKGLNILNSTN |
| SEQ ID NO: 21 | MEESIITGVKFKLRIDKETTKKLNEYFDEYGKAINFAVKIIQKELADDRFAGKAKLDQNK NPILDENGKKIYEFPDEFCSCGKQVNKYVNNKPFCQECYKIRFTENGIRKRMYSAKGRK AEHKINILNSTNKISKTHFNYAIREAFILDKSIKKQRKKRNERLRESKKRLQQFIDMRDG KREICPTIKGQKVDRFIHPSWITKDKKLEDFRGYTLSIINSKIKILDRNIKREEKSLKEKGQ IIFKAKRLMLDKSIRFVGDRKVLFTISKTLPKEYELDLPSKEKRLNWLKEKIEIIKNQKPK YAYLLRKNIESEKKPNYEYYLQYTLEIKPELKDFYDGAIGIDRGINHIAVCTFISNDGKVT PPKFFSSGEILRLKNLQKERDRFLLRKHNKNRKKGNMRVIENKINLILHRYSKQIVDMA KKLNASIVFEELGRIGKSRTKMKKSQRYKLSLFIFKKLSDLVDYKSRREGIRVTYVPPEY TSKECSHCGEKVNTQRPFNGNYSLFKCNKCGIQLNSDYNASINIAKKGLKIPNST |
| SEQ ID NO: 22 | LWTIVIGDFIEMPKQDLVTTGIKFKLDVDKETRKKLDDYFDEYGKAINFAVKIIQKNLKE DRFAGKIALGEDKKPLLDKDGKKIYNYPNESCSCGNQVRRYVNAKPFCVDCYKLKFTE NGIRKRMYSARGRKADSDINIKNSTNKISKTHFNYAIREGFILDKSLKKQRSKRIKKLLEL KRKLQEFIDIRQGQMVLCPKIKNQRVDKFIHPSWLKRDKKLEEFRGYSLSVVEGKIKIFN RNILREEDSLRQRGHVNFKANRIMLDKSVRFLDGGKVNFNLNKGLPKEYLLDLPKKEN KLSWLNEKISLIKLQKPKYAYLLRREGSFFIQYTIENVPKTFSDYLGAIGIDRGISHIAVCT FVSKNGVNKAPVFFSSGEILKLKSLQKQRDLFLRGKHNKIRKKSNMRNIDNKINLILHKY SRNIVNLAKSEKAFIVFEKLEKIKKSRFKMSKSLQYKLSQFTFKKLSDLVEYKAKIEGIK VDYVPPEYTSKECSHCGEKVDTQRPFNGNSSLFKCNKCRVQLNADYNASINIAKKSLNI SN |

TABLE 2-continued

Cas14 Sequences

| SEQ ID NO | Sequence |
|---|---|
| SEQ ID NO: 23 | MSKTTISVKLKIIDLSSEKKEFLDNYFNEYAKATTFCQLRIRRLLRNTHWLGKKEKSSKK<br>WIFESGICDLCGENKELVNEDRNSGEPAKICKRCYNGRYGNQMIRKLFVSTKKREVQEN<br>MDIRRVAKLNNTHYHRIPEEAFDMIKAADTAEKRRKKNVEYDKKRQMEFIEMFNDEK<br>KRAARPKKPNERETRYVHISKLESPSKGYTLNGIKRKIDGMGKKIERAEKGLSRKKIFGY<br>QGNRIKLDSNWVRFDLAESEITIPSLFKEMKLRITGPTNVHSKSGQIYFAEWFERINKQPN<br>NYCYLIRKTSSNGKYEYYLQYTYEAEVEANKEYAGCLGVDIGCSKLAAAVYYDSKNK<br>KAQKPIEIFTNPIKKIKMRREKLIKLLSRVKVRHRRRKLMQLSKTEPIIDYTCHKTARKIV<br>EMANTAKAFISMENLETGIKQKQQARETKKQKFYRNMFLFRKLSKLIEYKALLKGIKIV<br>YVKPDYTSQTCSSCGADKEKTERPSQAIFRCLNPTCRYYQRDINADFNAAVNIAKKALN<br>NTEVVTTLL |
| SEQ ID NO: 24 | MARAKNQPYQKLTTTTGIKFKLDLSEEEGKRFDEYFSEYAKAVNFCAKVIYQLRKNLK<br>FAGKKELAAKEWKFEISNCDFCNKQKEIYYKNIANGQKVCKGCHRTNFSDNAIRKKMI<br>PVKGRKVESKFNIHNTTKKISGTHRHWAFEDAADIIESMDKQRKEKQKRLRREKRKLSY<br>FFELFGDPAKRYELPKVGKQRVPRYLHKIIDKDSLTKKRGYSLSYIKNKIKISERNIERDE<br>KSLRKASPIAFGARKIKMSKLDPKRAFDLENNVFKIPGKVIKGQYKFFGTNVANEHGKK<br>FYKDRISKILAGKPKYFYLLRKKVAESDGNPIFEYYVQWSIDTETPAITSYDNILGIDAGI<br>TNLATTVLIPKNLSAEHCSHCGNNHVKPIFTKFFSGKELKAIKIKSRKQKYFLRGKHNKL<br>VKIKRIRPIEQKVDGYCHVVSKQIVEMAKERNSCIALEKLEKPKKSKFRQRRREKYAVS<br>MFVFKKLATFIKYKAAREGIEIIPVEPEGTSYTCSHCKNAQNNQRPYFKPNSKKSWTSM<br>FKCGKCGIELNSDYNAAFNIAQKALNMTSA |
| SEQ ID NO: 25 | MDEKHFFCSYCNKELKISKNLINKISKGSIREDEAVSKAISIHNKKEHSLILGIKFKLFIEN<br>KLDKKKLNEYFDNYSKAVTFAARIFDKIRSPYKFIGLKDKNTKKWTFPKAKCVFCLEEK<br>EVAYANEKDNSKICTECYLKEFGENGIRKKIYSTRGRKVEPKYNIFNSTKELSSTHYNYA<br>IRDAFQLLDALKKQRQKKLKSIFNQKLRLKEFEDIFSDPQKRIESLKPHQREKRYIHLSK<br>SGQESINRGYTLRFVRGKIKSLTRNIEREEKSLRKKTPIHFKGNRLMIFPAGIKFDFASNK<br>VKISISKNLPNEFNFSGTNVKNEHGKSFFKSRIELIKTQKPKYAYVLRKIKREYSKLRNYE<br>IEKIRLENPNADLCDFYLQYTIETESRNNEEINGIIGIDRGITNLACLVLLKKGDKKPSGVK<br>FYKGNKILGMKIAYRKHLYLLKGKRNKLRKQRQIRAIEPKINLILHQISKDIVKIAKEKNF<br>AIALEQLEKPKKARFAQRKKEKYKLALFTFKNLSTLIEYKSKREGIPVIYVPPEKTSQMC<br>SHCAINGDEHVDTQRPYKKPNAQKPSYSLFKCNKCGIELNADYNAAFNIAQKGLKTLM<br>LNHSH |
| SEQ ID NO: 26 | MLQTLLVKLDPSKEQYKMLYETMERFNEACNQIAETVFAIHSANKIEVQKTVYYPIREK<br>FGLSAQLTILAIRKVCEAYKRDKSIKPEFRLDGALVYDQRVLSWKGLDKVSLVTLQGRQ<br>IIPIKFGDYQKARMDRIRGQADLILVKGVFYLCVVVEVSEESPYDPKGVLGVDLGIKNLA<br>VDSDGEVHSGEQTTNTRERLDSLKARLQSKGTKSAKRHLKKLSGRMAKFSKDVNHCIS<br>KKLVAKAKGTLMSIALEDLQGIRDRVTVRKAQRRNLHTWNFGLLRMFVDYKAKIAGV<br>PLVFVDPRNTSRTCPSCGHVAKANRPTRDEFRCVSCGFAGAADHIAAMNIAFRAEVSQP<br>IVTRFFVQSQAPSFRVG |
| SEQ ID NO: 27 | MDEEPDSAEPNLAPISVKLKLVKLDGEKLAALNDYFNEYAKAVNFCELKMQKIRKNLV<br>NIRGTYLKEKKAWINQTGECCICKKIDELRCEDKNPDINGKICKKCYNGRYGNQMIRKL<br>FVSTNKRAVPKSLDIRKVARLHNTHYHRIPPEAADIIKAIETAERKRRNRILFDERRYNEL<br>KDALENEEKRVARPKKPKEREVRYVPISKKDTPSKGYTMNALVRKVSGMAKKIERAKR<br>NLNKRKKIEYLGRRILLDKNWVRFDFDKSEISIPTMKEFFGEMRFEITGPSNVMSPNGRE<br>YFTKWFDRIKAQPDNYCYLLRKESEDETDFYLQYTWRPDAHPKKDYTGCLGIDIGGSK<br>LASAVYFDADKNRAKQPIQIFSNPIGKWKTKRQKVIKVLSKAAVRHKTKKLESLRNIEP<br>RIDVHCHRIARKIVGMALAANAFISMENLEGGIREKQKAKETKKQKFSRNMFVFRKLSK<br>LIEYKALMEGVKVVYIVPDYTSQLCSSCGTNNTKRPKQAIFMCQNTECRYFGKNINADF<br>NAAINIAKKALNRKDIVRELS |
| SEQ ID NO: 28 | MEKNNSEQTSITTGIKFKLKLDKETKEKLNNYFDEYGKAINFAVRIIQMQLNDDRLAGK<br>YKRDEKGKPILGEDGKKILEIPNDFCSCGNQVNHYVNGVSFCQECYKKRFSENGIRKRM<br>YSAKGRKAEQDINIKNSTNKISKTHFNYAIREAFNLDKSIKKQREKRFKKLKDMKRKLQ<br>EFLEIRDGKRVICPKIEKQKVERYIHPSWINKEKKLEEFRGYSLSIVNSKIKSFDRNIQREE<br>KSLKEKGQINFKAQRLMLDKSVKFLKDNKVSFTISKELPKTFELDLPKKEKKLNWLNEK<br>LEIIKNQKPKYAYLLRKENNIFLQYTLDSIPEIHSEYSGAVGIDRGVSHIAVYTFLDKDGK<br>NERPPFFLSSSGILRLKNLQKERDKFLRKKHNKIRKKGNMRNIEQKINLILHEYSKQIVNF<br>AKDKNAFIVFELLEKPKKSRERMSKKIQYKLSQFTFKKLSDLVDYKAKREGIKVIYVEP<br>AYTSKDCSHCGERVNTQRPFNGNFSLFKCNKCGIVLNSDYNASLNIARKGLNISAN |
| SEQ ID NO: 29 | MAEEKFFFCEKCNKDIKIPKNYINKQGAEEKARAKHEHRVHALILGIKFKIYPKKEDISK<br>LNDYFDEYAKAVTFTAKIVDKLKAPFLFAGKRDKDTSKKKWFVPVDKCSFCKEKTEIN<br>YRTKQGKNICNSCYLTEFGEQGLLEKIYATKGRKVSSSFNLFNSTKKLTGTHNNYVVKE<br>SLQLLDALKKQRSKRLKKLSNTRRKLKQFEEMFEKEDKRFQLPLKEKQRELRFIHVSQK<br>DRATEFKGYTMNKIKSKIKVLRRNIEREQRSLNRKSPVFFRGTRIRLSPSVQFDDKDNKI<br>KLTLSKELPKEYSFSGLNVANEHGKRFFAEKLKLIKENKSKYAYLLRRQVNKNNKKPIY<br>DYYLQYTVEFLPNIITNYNGILGIDRGINTLACIVLLENKKEKPSFVKFFSGKGILNLKNK<br>RRKQLYFLKGVHNKYRKQQKIRPIEPRIDQILHDISKQIIDLAKEKRVAISLEQLEKPQKP<br>KFRQSRKAKYKLSQFNFKTLSNYIDYKAKKEGIRVIYIAPEMTSQNCSRCAMKNDLHVN<br>TQRPYKNTSSLFKCNKCGVELNADYNAAFNIAQKGLKILNS |

TABLE 2-continued

Cas14 Sequences

| SEQ ID NO | Sequence |
|---|---|
| SEQ ID NO: 30 | MISLKLKLLPDEEQKKLLDEMFWKWASICTRVGFGRADKEDLKPPKDAEGVWFSLTQL NQANTDINDLREAMKHQKHRLEYEKNRLEAQRDDTQDALKNPDRREISTKRKDLFRPK ASVEKGFLKLKYHQERYWVRRLKEINKLIERKTKTLIKIEKGRIKFKATRITLHQGSFKIR FGDKPAFLIKALSGKNQIDAPFVVVPEQPICGSVVNSKKYLDEITTNFLAYSVNAMLFGL SRSEEMLLKAKRPEKIKKKEEKLAKKQSAFENKKKELQKLLGRELTQQEEAIIEETRNQF FQDFEVKITKQYSELLSKIANELKQKNDFLKVNKYPILLRKPLKKAKSKKINNLSPSEWK YYLQFGVKPLLKQKSRRKSRNVLGIDRGLKHLLAVTVLEPDKKTFVWNKLYPNPITGW KWRRRKLLRSLKRLKRRIKSQKHETIHENQTRKKLKSLQGRIDDLLHNISRKIVETAKEY DAVIVVEDLQSMRQHGRSKGNRLKTLNYALSLFDYANVMQLIKYKAGIEGIQIYDVKP AGTSQNCAYCLLAQRDSHEYKRSQENSKIGVCLNPNCQNHKKQIDADLNAARVIASCY ALKINDSQPFGTRKRFKKRTTN |
| SEQ ID NO: 31 | METLSLKLKLNPSKEQLLVLDKMFWKWASICTRLGLKKAEMSDLEPPKDAEGVWFSK TQLNQANTDVNDLRKAMQHQGKRIEYELDKVENRRNEIQEMLEKPDRRDISPNRKDLF RPKAAVEKGYLKLKYHKLGYWSKELKTANKLIERKRKTLAKIDAGKMKFKPTRISLHT NSFRIKFGEEPKIALSTTSKHEKIELPLITSLQRPLKTSCAKKSKTYLDAAILNFLAYSTNA ALFGLSRSEEMLLKAKKPEKIEKRDRKLATKRESFDKKLKTLEKLLERKLSEKEKSVFK RKQTEFFDKFCITLDETYVEALHRIAEELVSKNKYLEIKKYPVLLRKPESRLRSKKLKNL KPEDWTYYIQFGFQPLLDTPKPIKTKTVLGIDRGVRHLLAVSIFDPRTKFTFTFNRLYSNPI VDWKWRRRKLLRSIKRLKRRLKSEKHVHLHENQFKAKLRSLEGRIEDHFHNLSKEIVD LAKENNSVIVVENLGGMRQHGRGRGKWLKALNYALSHFDYAKVMQLIKYKAELAGV FVYDVAPAGTSINCAYCLLNDKDASNYTRGKVINGKKNTKIGECKTCKKEFDADLNAA RVIALCYEKRLNDPQPFGTRKQFKPKKP |
| SEQ ID NO: 32 | MKALKLQLIPTRKQYKILDEMFWKWASLANRVSQKGESKETLAPKKDIQKIQFNATQL NQIEKDIKDLRGAMKEQQKQKERLLLQIQERRSTISEMLNDDNNKERDPHRPLNFRPKG WRKFHTSKHWVGELSKILRQEDRVKKTIERIVAGKISFKPKRIGIWSSSNYKINFFKRKISI NPLNSKGFELTLMTEPTQDLIGKNGGKSVLNNKRYLDDSIKSLLMFALHSRFFGLNNTD TYLLGGKINPSLVKYYKKNQDMGEFGREIVEKFERKLKQEINEQQKKIIMSQIKEQYSN RDSAFNKDYLGLINEFSEVFNQRKSERAEYLLDSFEDKIKQIKQEIGESLNISDWDFLIDE AKKAYGYEEGFTEYVYSKRYLEILNKIVKAVLITDIYFDLRKYPILLRKPLDKIKKISNLK PDEWSYYIQFGYDSINPVQLMSTDKFLGIDRGLTHLLAYSVFDKEKKEFIINQLEPNPIM GWKWKLRKVKRSLQHLERRRIRAQKMVKLPENQMKKKLKSIEPKIEVHYHNISRKIVNL AKDYNASIVVESLEGGGLKQHGRKKNARNRSLNYALSLFDYGKIASLIKYKADLEGVP MYEVLPAYTSQQCAKCVLEKGSFVDPEIIGYVEDIGIKGSLLDSLFEGTELSSIQVLKKIK NKIELSARDNHNKEINLILKYNFKGLVIVRGQDKEEIAEHPIKEINGKFAILDFVYKRGKE KVGKKGNQKVRYTGNKKVGYCSKHGQVDADLNASRVIALCKYLDINDPILFGEQRKSF K |
| SEQ ID NO: 33 | MVTRAIKLKLDPTKNQYKLLNEMFWKWASLANRFSQKGASKETLAPKDGTQKIQFNA TQLNQIKKDVDDLRGAMEKQGKQKERLLIQIQERLLTISEILRDDSKKEKDPHRPQNFRP FGWRRFHTSAYWSSEASKLTRQVDRVRRTIERIKAGKINFKPKRIGLWSSSTYKINFLKKK INTSPLKSKSFELDLITEPQQKIIGKEGGKSVANSKKYLDDSIKSLLIFAIKSRLFGLNNKD KPLFENIITPNLVRYHKKGQEQENFKKEVIKKFENKLKKEISQKQKEIIFSQIERQYENRD ATFSEDYLRAISEFSEIFNQRKKERAKELLNSFNEKIRQLKKEVNGNISEEDLKILEVEAE KAYNYENGFIEWEYSEQFLGVLEKIARAVLISDNYFDLKKYPILIRKPTNKSKKITNLKPE EWDYYIQFGYGLINSPMKIETKNFMGIDRGLTHLLAYSIFDRDSEKFTINQLELNPIKGW KWKLRKVKRSLQHLERRMRAQKGVKLPENQMKKRLKSIEPKIESYYHNLSRKIVNLAK ANNASIVVESLEGGGLKQHGRKKNSRHRALNYALSLFDYGKIASLIKYKSDLEGVPMY EVLPAYTSQQCAKCVLKKGSFVEPEIIGYIEEIGFKENLLTLLFEDTGLSSVQVLKKSKNK MTLSARDKEGKMVDLVLKYNFKGLVISQEKKKEEIVEFPIKEIDGKFAVLDSAYKRGKE RISKKGNQKLVYTGNKKVGYCSVHGQVDADLNASRVIALCKYLGINEPIVFGEQRKSF K |
| SEQ ID NO: 34 | LDLITEPIQPHKSSSLRSKEFLEYQISDFLNFSLHSLFFGLASNEGPLVDFKIYDKIVIPKPE ERFPKKESEEGKKLDSFDKRVEEYYSDKLEKKIERKLNTEEKNVIDREKTRIWGEVNKL LLAKKYSKFDDKIKKIKEDYGLEFDENTIKKEGEKAFLNPDKFSKYQFSSSYLKLIGEIAR SLITYKGFLDLNKYPIIFRKPINKVKKIHNLEPDEWKYYIQFGYEQINNPKLETENILGIDR GLTHILAYSVFEPRSSKFILNKLEPNPIEGWKWKLRKLRRSIQNLERRWRAQDNVKLPE NQMKKNLRSIEDKVENLYHNLSRKIVDLAKEKNACIVFEKLEGQGMKQHGRKKSDRL RGLNYKLSLFDYGKIAKLIKYKAEIEGIPIYRIDSAYTSQNCAKCVLESRRFAQPEEISCL DDFKEGDNLDKRILEGTGLVEAKIYKLLKEKKEDFEIEEDIAMFDTKKVIKENKEKTVI LDYVYTRRKEIIGTNHKKNIKGIAKYTGNTKIGYCMKHGQVDADLNASRTIALCKNFDI NNPEIWK |
| SEQ ID NO: 35 | MSDESLVSSEDKLAIKIKIVPNAEQAKMLDEMFKKWSSICNRISRGKEDIETLRPDEGKE LQFNSTQLNSATMDVSDLKKAMARQGERLEAEVSKLRGRYETIDASLRDPSRRHTNPQ KPSSFYPSDWDISGRLTPRFHTARHYSTELRKLKAKEDKMLKTINKIKNGKIVFKPKRIT LWPSSVNMAFKGSRLLLKPFANGFEMELPIVISPQKTADGKSQKASAEYMRNALLGLA GYSINQLLFGMNRSQKMLANAKKPEKVEKFLEQMKNDANFDKKIKALEGKWLLDRK LKESEKSSIAVVRTKFFKSGKVELNEDYLKLLKHMANEILERDGFVNLNKYPILSRKPM KRYKQKNIDNLKPNMWKYYIQFGYEPIFERKASGKPKNIMGIDRGLTHLLAVAVFSPDQ QKFLFNHLESNPIMHWKWKLRKIRRSIQHMERRIRAEKNKHIHEAQLKKRLGSIEEKTE |

TABLE 2-continued

Cas14 Sequences

| SEQ ID NO | Sequence |
|---|---|
| | QHYHIVSSKIINWAIEYEAAIVLESLSHMKQRGGKKSVRTRALNYALSLFDYEKVARLIT YKARIRGIPVYDVLPGMTSKTCATCLLNGSQGAYVRGLETTKAAGKATKRKNMKIGKC MVCNSSENSMIDADLNAARVIAICKYKNLNDPQPAGSRKVFKRF |
| SEQ ID NO: 36 | MLALKLKIMPTEKQAEILDAMFWKWASICSRIAKMKKKVSVKENKKELSKKIPSNSDI WFSKTQLCQAEVDVGDHKKALKNFEKRQESLLDELKYKVKAINEVINDESKREIDPNN PSKFRIKDSTKKGNLNSPKFFTLKKWQKILQENEKRIKKKESTIEKLKRGNIFFNPTKISL HEEEYSINFGSSKLUNCFYKYNKKSGINSDQLENKFNEFQNGLNIICSPLQPIRGSSKRSF EFIRNSIINPLMYSLYAKLFGIPRSVKALMKSNKDENKLKLEEKLKKKKSSFNKTVKEFE KMIGRKLSDNESKILNDESKKFFEIIKSNNKYIPSEEYLKLLKDISEEIYNSNIDFKPYKYSI LIRKPLSKFKSKKLYNLKPTDYKYYLQLSYEPFSKQLIATKTILGIDRGLKHLLAVSVFDP SQNKFVYNKLIKNPVFKWKKRYHDLKRSIRNRERRIRALTGVHIHENQLIKKLKSMKNK INVLYHNVSKNIVDLAKKYESTIVLERLENLKQHGRSKGKRYKKLNYVLSNFDYKKIES LISYKAKKEGVPVSNINPKYTSKTCAKCLLEVNQLSELKNEYNRDSKNSKIGICNIHGQI DADLNAARVIALCYSKNLNEPHFK |
| SEQ ID NO: 37 | VINLFGYKFALYPNKTQEELLNKHLGECGWLYNKAIEQNEYYKADSNIEEAQKKFELLP DKNSDEAKVLRGNISKDNYVYRTLVKKKKSEINVQIRKAVVLRPAETIRNLAKVKKKG LSVGRLKFIPIREWDVLPFKQSDQIRLEENYLILEPYGRLKFKMHRPLLGKPKTFCIKRTA TDRWTISFSTEYDDSNMRKNDGGQVGIDVGLKTHLRLSNENPDEDPRYPNPKIWKRYD RRLTILQRRISKSKKLGKNRTRLRLRLSRLWEKIRNSRADLIQNETYEILSENKLIAIEDLN VKGMQEKKDKKGRKGRTRAQEKGLHRSISDAAFSEFRRVLEYKAKRFGSEVKPVSAID SSKECHNCGNKKGMPLESRIYECPKCGLKIDRDLNSAKVILARATGVRPGSNARADTKI SATAGASVQTEGTVSEDFRQQMETSDQKPMQGEGSKEPPMNPEHKSSGRGSKHVNIGC KNKVGLYNEDENSRSTEKQIMDENRSTTEDMVEIGALHSPVLTT |
| SEQ ID NO: 38 | MIASIDYEAVSQALIVFEFKAKGKDSQYQAIDEAIRSYRFIRNSCLRYWMDNKKVGKYD LNKYCKVLAKQYPFANKLNSQARQSAAECSWSAISRFYDNCKRKVSGKKGFPKFKKH ARSVEYKTSGWKLSENRKAITFTDKNGIGKLKLKGTYDLHFSQLEDMKRVRLVRRADG YVVQFCISVDVKVETEPTGKAIGLDVGIKYFLADSSGNTIENPQFYRKAEKKLNRANRR KSKKYIRGVKPQSKNYHKARCRYARKHLRVSRQRKEYCKRVAYCVIHSNDVVAYEDL NVKGMVKNRHLAKSISDVAWSTFRHWLEYFAIKYGKLTIPVAPHNTSQNCSNCDKKVP KSLSTRTHICHHCGYSEDRDVNAAKNILKKALSTVGQTGSLKLGEIEPLLVLEQSCTRKF DL |
| SEQ ID NO: 39 | LAEENTLHLTLAMSLPLNDLPENRTRSELWRRQWLPQKKLSLLLGVNQSVRKAAADCL RWFEPYQELLWWEPTDPDGKKLLDKEGRPIKRTAGHMRVLRKLEEIAPFRGYQLGSAV KNGLRHKVADLLLSYAKRKLDPQFTDKTSYPSIGDQFPIVWTGAFVCYEQSITGQLYLY LPLFPRGSHQEDITNNYDPDRGPALQVFGEKEIARLSRSTSGLLLPLQFDKWGEATFIRG ENNPPTWKATHRRSDKKWLSEVLLREKDFQPKRVELLVRNGRIFVNVACEIPTKPLLEV ENFMGVSFGLEHLVTVVVINRDGNVVHQRQEPARRYEKTYFARLERLRRRGGPFSQEL ETFHYRQVAQIVEEALRFKSVPAVEQVGNIPKGRYNPRLNLRLSYWPFGKLADLTSYKA VKEGLPKPYSVYSATAKMLCSTCGAANKEGDQPISLKGPTVYCGNCGTRHNTGFNTAL NLARRAQELFVKGVVAR |
| SEQ ID NO: 40 | MSQSLLKWHDMAGRDKDASRSLQKSAVEGVLLHLTASHRVALEMLEKSVSQTVAVT MEAAQQRLVIVLEDDPTKATSRKRVISADLQFTREEFGSLPNWAQKLASTCPEIATKYA DKHINSIRIAWGVAKESTNGDAVEQKLQWQIRLLDVTMFLQQLVLQLADKALLEQIPSS IRGGIGQEVAQQVTSHIQLLDSGTVLKAELPTISDRNSELARKQWEDAIQTVCTYALPFS RERARILDPGKYAAEDPRGDRLINIDPMWARVLKGPTVKSLPLLFVSGSSIRIVKLTLPR KHAAGHKHTFTATYLVLPVSREWINSLPGTVQEKVQWWKKPDVLATQELLVGKGALK KSANTLVIPISAGKKRFFNHILPALQRGFPLQWQRIVGRSYRRPATHRKWFAQLTIGYTN PSSLPEMALGIHFGMKDILWWALADKQGNILKDGSIPGNSILDFSLQEKGKIERQQKAG KNVAGKKYGKSLLNATYRVVNGVLEFSKGISAEHASQPIGLGLETIRFVDKASGSSPVN ARHSNWNYGQLSGIFANKKAGPAGFSVTEITLKKAQRDLSDAEQARVLAIEATKRFASRI KRLATKRKDDTLFV |
| SEQ ID NO: 41 | VEPVEKERFYYRTYTFRLDGQPRTQNLTTQSGWGLLTKAVLDNTKHYWEIVHHARIAN QPIVFENPVIDEQGNPKLNKLGQPRFWKRPISDIVNQLRALFENQNPYQLGSSLIQGTYW DVAENLASWYALNKEYLAGTATWGEPSFPEPHPLTEINQWMPLTFSSGKVVRLLKNAS GRYFIGLPILGENNPCYRMRTIEKLIPCDGKGRVTSGSLILFPLVGIYAQQHRRMTDICESI RTEKGKLAWAQVSIDYVREVDKRRRMRRTRKSQGWIQGPWQEVFILRLVLAHKAPKL YKPRCFAGISLGPKTLASCVILDQDERVVEKQQWSGSELLSLIHQGEERLRSLREQSKPT WNAAYRKQLKSLINTQVFTIVTFLRERGAAVRLESIARVRKSTPAPPVNFLLSHWAYRQ ITERLKDLAIRNGMPLTHSNGSYGVRFTCSQCGATNQGIKDPTKYKVDIESETFLCSICSH REIAAVNTATNLAKQLLDE |
| SEQ ID NO: 42 | MNDTETSETLTSHRTVCAHLHVVGETGSLPRLVEAALAELITLNGRATQALLSLAKNGL VLRRDKEENLIAAELTLPCRKNKYADVAAKAGEPILATRINNKGKLVTKKWYGEGNSY HIVRFTPETGMFTVRVFDRYAFDEELLHLHSEVVFGSDLPKGIKAKTDSLPANFLQAVFT SFLELPFQGFPDIVVKPAMKQAAEQLLSYVQLEAGENQQAEYPDTNERDPELRLVEWQ KSLHELSVRTEPFEFVRARDIDYYAETDRRGNRFVNITPEWTKFAESPFARRLPLKIPPEF CILLRRKTEGHAKIPNRIYLGLQIFDGVTPDSTLGVLATAEDGKLFWWHDHLDEFSNLE GKPEPKLKNKPQLLMVSLEYDREQRFEESVGGDRKICLVTLKETRNFRRGWNGRILGIH |

TABLE 2-continued

Cas14 Sequences

| SEQ ID NO | Sequence |
| --- | --- |
| | FQHNPVITWALMDHDAEVLEKGFIEGNAFLGKALDKQALNEYLQKGGKWVGDRSFGN<br>KLKGITHTLASLIVRLAREKDAWIALEEISWVQKQSADSVANHEIVEQPHHSLTR |
| SEQ ID NO: 43 | MNDTETSETLTSHRTVCAHLHVVGETGSLPRLVEAALAELITLNGRATQALLSLAKNGL<br>VLRRDKEENLIAAELTLPCRKNKYADVAAKAGEPILATRINNKGKLVTKKWYGEGNSY<br>HIVRFTPETGMFTVRVFDRYAFDEELLHLHSEVVFGSDLPKGIKAKTDSLPANFLQAVFT<br>SFLELPFQGFPDIVVKPAMKQAAEQLLSYVQLEAGENQQAEYPDTNERDPELRLVEWQ<br>KSLHELSVRTEPFEFVRARDIDYYAETDRRGNRFVNITPEWTKFAESPFARRLPLKIPPEF<br>CILLRRKTEGHAKIPNRIYLGLQIFDGVTPDSTLGVLATAEDGKLFWWHDHLDEFSNLE<br>GKPEPKLKNKPQLLMVSLEYDREQRFEESVGGDRKICLVTLKETRNFRRGRHGHTRTD<br>RLPAGNTLWRADFATSAEVAAPKWNGRILGIHFQHNPVITWALMDHDAEVLEKGFIEG<br>NAFLGKALDKQALNEYLQKGGKWVGDRSFGNKLKGITHTLASLIVRLAREKDAWIALE<br>EISWVQKQSADSVANRRFSMWNYSRLATLIEWLGTDIATRDCGTAAPLAHKVSDYLTH<br>FTCPECGACRKAGQKKEIADTVRAGDILTCRKCGFSGPIPDNFIAEFVAKKALERMLKK<br>KPV |
| SEQ ID NO: 44 | MAKRNFGEKSEALYRAVRFEVRPSKEELSILLAVSEVLRMLFNSALAERQQVFTEFIASL<br>YAELKSASVPEEISEIRKKLREAYKEHSISLFDQINALTARRVEDEAFASVTRNWQEETL<br>DALDGAYKSFLSLRRKGDYDAHSPRSRDSGFFQKIPGRSGFKIGEGRIALSCGAGRKLSF<br>PIPDYQQGRLAETTKLKKFELYRDQPNLAKSGRFWISVVYELPKPEATTCQSEQVAFVA<br>LGASSIGVVSQRGEEVIALWRSDKHWVPKIEAVEERMKRRVKGSRGWLRLLNSGKRR<br>MHMISSRQHVQDEREIVDYLVRNHGSHFVVTELVVRSKEGKLADSSKPERGGSLGLNW<br>AAQNTGSLSRLVRQLEEKVKEHGGSVRKHKLTLTEAPPARGAENKLWMARKLRESFL<br>KEV |
| SEQ ID NO: 45 | LAKNDEKELLYQSVKFEIYPDESKIRVLTRVSNILVLVWNSALGERRARFELYIAPLYEE<br>LKKFPRKSAESNALRQKIREGYKEHIPTFFDQLKKLLTPMRKEDPALLGSVPRAYQEETL<br>NTLNGSFVSFMTLRRNNDMDAKPPKGRAEDRFHEISGRSGFKIDGSEFVLSTKEQKLRF<br>PIPNYQLEKLKEAKQIKKFTLYQSRDRRFWISIAYEIELPDQRPFNPEEVIYIAFGASSIGVI<br>SPEGEKVIDFWRPDKHWKPKIKEVENRMRSCKKGSRAWKKRAAARRKMYAMTQRQQ<br>KLNHREIVASLLRLGFHFVVTEYTVRSKPGKLADGSNPKRGGAPQGFNWSAQNTGSFG<br>EFILWLKQKVKEQGGTVQTFRLVLGQSERPEKRGRDNKIEMVRLLREKYLESQTIVV |
| SEQ ID NO: 46 | MAKGKKKEGKPLYRAVRFEIFPTSDQITLFLRVSKNLQQVWNEAWQERQSCYEQFFGSI<br>YERIGQAKKRAQEAGFSEVWENEAKKGLNKKLRQQEISMQLVSEKESLLQELSIAFQEH<br>GVTLYDQINGLTARRIIGEFALIPRNWQEETLDSLDGSFKSFLALRKNGDPDAKPPRQRV<br>SENSFYKIPGRSGFKVSNGQIYLSFGKIGQTLTSVIPEFQLKRLETAIKLKKFELCRDERD<br>MAKPGRFWISVAYEIPKPEKVPVVSKQITYLAIGASRLGVVSPKGEFCLNLPRSDYHWK<br>PQINALQERLEGVVKGSRKWKKRMAACTRMFAKLGHQQKQHGQYEVVKKLLRHGVH<br>FVVTELKVRSKPGALADASKSDRKGSPTGPNWSAQNTGNIARLIQKLTDKASEHGGTVI<br>KRNPPLLSLEERQLPDAQRKIFIAKKLREEFLADQK |
| SEQ ID NO: 47 | MAKREKKDDVVLRGTKMRIYPTDRQVTLMDMWRRRCISLWNLLLNLETAAYGAKNT<br>RSKLGWRSIWARVVEENHAKALIVYQHGKCKKDGSFVLKRDGTVKHPPRERFPGDRKI<br>LLGLFDALRHTLDKGAKCKCNVQPYALTRAWLDETGHGARTADIIAWLKDFKGECD<br>CTAISTAAKYCPAPPTAELLTKIKRAAPADDLPVDQAILLDLFGALRGGLKQKECDHTH<br>ARTVAYFEKHELAGRAEDILAWLIAHGGTCDCKIVEEAANHCPGPRLFIWEHELAMIM<br>ARLKAEPRTEWIGDLPSHAAQTVVKDLVKALQTMLKERAKAAAGDESARKTGFPKFK<br>KQAYAAGSVYFPNTTMFFDVAAGRVQLPNGCGSMRCEIPRQLVAELLERNLKPGLVIG<br>AQLGLLGGRIWRQGDRWYLSCQWERPQPTLLPKTGRTAGVKIAASIVFTTYDNRGQTK<br>EYPMPPADKKLTAVHLVAGKQNSRALEAQKEKEKKLKARKERLRLGKLEKGHDPNAL<br>KPLKRPRVRRSKLFYKSAARLAACEAIERDRRDGFLHRVTNEIVHKFDAVSVQKMSVA<br>PMMRRQKQKEKQIESKKNEAKKEDNGAAKKPRNLKPVRKLLRHVAMARGRQFLEYK<br>YNDLRGPGSVLIADRLEPEVQECSRCGTKNPQMKDGRRLLRCIGVLPDGTDCDAVLPR<br>NRNAARNAEKRLRKHREAHNA |
| SEQ ID NO: 48 | MNEVLPIPAVGEDAADTIMRGSKMRIYPSVRQAATMDLWRRRCIQLWNLLLELEQAAY<br>SGENRRTQIGWRSIWATVVEDSHAEAVRVAREGKKRKDGTFRKAPSGKEIPPLDPAML<br>AKIQRQMNGAVDVDPKTGEVTPAQPRLFMWEHELQKIMARLKQAPRTHWIDDLPSHA<br>AQSVVKDLIKALQAMLRERKKRASGIGGRDTGFPKFKKNRYAAGSVYFANTQLRFEAK<br>RGKAGDPDAVRGEFARVKLPNGVGWMECRMPRHINAAHAYAQATLMGGRIWRQGE<br>NWYLSCQWKMPKPAPLPRAGRTAAIKIAAAIPITTVDNRGQTREYAMPPIDRERIAAHA<br>AAGRAQSRALEARKRRAKKREAYAKKRHAKKLERGIAAKPPGRARIKLSPGFYAAAA<br>KLAKLEAEDANAREAWLHEITTQIVRNFDVIAVPRMEVAKLMKKPEPPEEKEEQVKAP<br>WQGKRRSLKAARVMMRRTAMALIQTTLKYKAVDLRGPQAYEEIAPLDVTAAACSGCG<br>VLKPEWKMARAKGREIMRCQEPLPGGKTCNTVLTYTRNSARVIGRELAVRLAERQKA |
| SEQ ID NO: 49 | MTTQKTYNFCFYDQRFFELSKEAGEVYSRSLEEFWKIYDETGVWLSKFDLQKHMRNKL<br>ERKLLHSDSFLGAMQQVHANLASWKQAKKVVPDACPPRKPKFLQAILFKKSQIKYKNG<br>FLRRLTLGTEKEFLYLKWDINIPLPIYGSVTYSKTRGWKINLCLETEVEQKNLSENKYLSID<br>LGVKRVATIFDGENTITLSGKKFMGLMHYRNKLNGKTQSRLSHKKGSNNYKKIQRAK<br>RKTTDRLLNIQKEMLHKYSSFIVNYAIRNDIGNIIIGDNSSTHDSPNMRGKTNQKISQNPE<br>QKLKNYIKYKFESISGRVDIVPEPYTSRKCPHCKNIKKSSPKGRTYKCKKCGFIFDRDGV<br>GAINIYNENVSFGQIISPGRIRSLTEPIGMKFHNEIYFKSYVAA |

TABLE 2-continued

Cas14 Sequences

| SEQ ID NO | Sequence |
|---|---|
| SEQ ID NO: 50 | MSVRSFQARVECDKQTMEHLWRTHKVFNERLPEIIKILFKMKRGECGQNDKQKSLYKS ISQSILEANAQNADYLLNSVSIKGWKPGTAKKYRNASFTWADDAAKLSSQGIHVYDKK QVLGDLPGMMSQMVCRQSVEAISGHIELTKKWEKEHNEWLKEKEKWESEDEHKKYL DLREKFEQFEQSIGGKITKRRGRWHLYLKWLSDNPDFAAWRGNKAVINPLSEKAQIRIN KAKPNKKNSVERDEFFKANPEMKALDNLHGYYERNFVRRRKTKKNPDGFDHKPTFTL PHPTIHPRWFVFNKPKTNPEGYRKLILPKKAGDLGSLEMRLLTGEKNKGNYPDDWISVK FKADPRLSLIRPVKGRRVRKGKEQGQTKETDSYEFFDKHLKKWRPAKLSGVKLIFPDK TPKAAYLYFTCDIPDEPLTETAKKIQWLETGDVTKKGKKRKKKVLPHGLVSCAVDLSM RRGTTGFATLCRYENGKIHILRSRNLWVGYKEGKGCHPYRWTEGPDLGHIAKHKREIRI LRSKRGKPVKGEESHIDLQKHIDYMGEDRFKKAARTIVNFALNTENAASKNGFYPRAD VLLLENLEGLIPDAEKERGINRALAGWNRRHLVERVIEMAKDAGFKRRVFEIPPYGTSQ VCSKCGALGRRYSIIRENNRREIRFGYVEKLFACPNCGYCANADHNASVNLNRRFLIED SFKSYYDWKRLSEKKQKEEIETIESKLMDKLCAMHKISRGSISK |
| SEQ ID NO: 51 | MHLWRTHCVFNQRLPALLKRLFAMRRGEVGGNEAQRQVYQRVAQFVLARDAKDSVD LLNAVSLRKRSANSAFKKKATISCNGQAREVTGEEVFAEAVALASKGVFAYDKDDMR AGLPDSLFQPLTRDAVACMRSHEELVATWKKEYREWRDRKSEWEAEPEHALYLNLRP KFEEGEAARGGRFRKRAERDHAYLDWLEANPQLAAWRRKAPPAVVPIDEAGKRRIAR AKAWKQASVRAEEFWKRNPELHALHKIHVQYLREFVRPRRTRRNKRREGFKQRPTFT MPDPVRHPRWCLFNAPQTSPQGYRLLRLPQSRRTVGSVELRLLTGPSDGAGFPDAWVN VRFKADPRLAQLRPVKVPRTVTRGKNKGAKVEADGFRYYDDQLLIERDAQVSGVKLL FRDIRMAPFADKPIEDRLLSATPYLVFAVEIKDEARTERAKAIRFDETSELTKSGKKRKT LPAGLVSVAVDLDTRGVGFLTRAVIGVPEIQQTHHGVRLLQSRYVAVGQVEARASGEA EWSPGPDLAHIARHKREIRRLRQLRGKPVKGERSHVRLQAHIDRMGEDRFKKAARKIV NEALRGSNPAAGDPYTRADVLLYESLETLLLPDAERERGINRALLRWNRAKLIEHLKRM CDDAGIRHFPVSPFGTSQVCSKCGALGRRYSLARENGRAVIRFGWVERLFACPNPECPG RRPDRPDRPFTCNSDHNASVNLHRVFALGDQAVAAFRALAPRDSPARTLAVKRVEDTL RPQLMRVHKLADAGVDSPF |
| SEQ ID NO: 52 | MATLVYRYGVRAHGSARQQDAVVSDPAMLEQLRLGHELRNALVGVQHRYEDGKRAV WSGFASVAAADHRVTTGETAVAELEKQARAEHSADRTAATRQGTAESLKAARAAVK QARADRKAAMAAVAEQAKPKIQALGDDRDAEIKDLYRRFCQDGVLLPRCGRCAGDLR SDGDCTDCGAAHEPRKLYWATYNAIREDHQTAVKLVEAKRKAGQPARLRFRRWTGD GTLTVQLQRMHGPACRCVTCAEKLTRRARKTDPQAPAVAADPAYPPTDPPRDPALLAS GQGKWRNVLQLGTWIPPGEWSAMSRAERRRVGRSHIGWQLGGGRQLTLPVQLHRQM PADADVAMAQLTRVRVGGRHRMSVALTAKLPDPPQVQGLPPVALHLGWRQRPDGSL RVATWACPQPLDLPPAVADVVVSHGGRWGEVIMPARWLADAEVPPRLLGRRDKAME PVLEALADWLEAHTEACTARMTPALVRRWRSQGRLAGLTNRWRGQPPTGSAEILTYLE AWRIQDKLLWERESHLRRRLAARRDDAWRRVASWLARHAGVLVVDDADIAELRRRD DPADTDPTMPASAAQAARARAALAAPGRLRHLATITATRDGLGVHTVASAGLTRLHR KCGHQAQPDPRYAASAVVTCPGCGNGYDQDYNAAMLMLDRQQQP |
| SEQ ID NO: 53 | MSRVELHRAYKFRLYPTPAQVAELAEWERQLRRLYNLAHSQRLAAMQRHVRPKSPGV LKSECLSCGAVAVAEIGTDGKAKKTVKHAVGCSVLECRSCGGSPDAEGRTAHTAACSF VDYYRQGREMTQLLEEDDQLARVVCSARQETLRDLEKAWQRWHKMPGFGKPHFKKR IDSCRIYFSTPKSWAVDLGYLSFTGVASSVGRIKIRQDRVWPGDAKFSSCHVVRDVDEW YAVFPLTFTKEIEKPKGGAVGINRGAVHAIADSTGRVVDSPKFYARSLGVIRHRARLLD RKVPFGRAVKPSPTKYHGLPKADIDAAAARVNASPGRLVYEARARGSIAAAEEAHLAAL VLPAPRQTSQLPSEGRNRERARRFLALAHQRVRRQREWFLHNESAHYAQSYTKIAIED WSTKEMTSSEPRDAEEMKRVTRARNRSILDVGWYELGRQIAYKSEATGAEFAKVDPGL RETETHVPEAIVRERDVDVSGMLRGEAGISGTCSRCGGLLRASASGHADAECEVCLHVE VGDVNAAVNVLKRAMFPGAAPPSKEKAKVTIGIKGRKKKRAA |
| SEQ ID NO: 54 | MSRVELHRAYKFRLYPTPVQVAELSEWERQLRRLYNLGHEQRLLTLTRHLRPKSPGVL KGECLSCDSTQVQEVGADGRPKTTVRHAEQCPTLACRSCGALRDAEGRTAHTVACAF VDYYRQGREMTELLAADDQLARVVCSARQEVLRDLDKAWQRWRKMPGFGKPRFKRR TDSCRIYFSTPKAWKLEGGHLSFTGAATTVGAIKMRQDRNWPASVQFSSCHVVRDVDE WYAVFPLTFVAEVARPKGGAVGINRGAVHAIADSTGRVVDSPRYYARALGVIRHRARL FDRKVPSGHAVKPSPTKYRGLSAIEVDRVARATGFTPGRVVTEALNRGGVAYAECALA AIAVLGHGPERPLTSDGRNREKARKFLALAHQRVRRQREWFLHNESAHYARTYSKIAIE DWSTKEMTASEPQGEETRRVTRSRNRSILDVGWYELGRQLAYKTEATGAEFAQVDPGL KETETNVPKAIADARDVDVSGMLRGEAGISGTCSKCGGLLRAPASGHADAECEICLNVE VGDVNAAVNVLKRAMFPGDAPPASGEKPKVSIGIKGRQKKKKAA |
| SEQ ID NO: 55 | MEAIATGMSPERRVELGILPGSVELKRAYKFRLYPMKVQQAELSEWERQLRRLYNLAH EQRLAALLRYRDWDFQKGACPSCRVAVPGVHTAACDHVDYFRQAREMTQLLEVDAQ LSRVICCARQEVLRDLDKAWQRWKKLGGRPRFKRRTDSCRIYLSTPKHWEIAGRYLR LSGLASSVGEIRIEQDRAFPEGALLSSCSIVRDVDEWYACLPLTFTQPIERAPHRSVGLNR GVVHALADSDGRVVDSPKFFERALATVQKRSRDLARKVSGSRNAHKARIKLAKAHQR VRRQRAAFLHQESAYYSKGFDLVALEDMSVRKMTATAGEAPEMGRGAQRDLNRGILD VGWYELARQIDYKRLAHGGELLRVDPGQTTPLACVTEEQPARGISSACAVCGIPLARPA SGNARMRCTACGSSQVGDVNAAENVLTRALSSAPSGPKSPKASIKIKGRQKRLGTPAN RAGEASGGDPPVRGPVEGGTLAYVVEPVSESQSDT |

TABLE 2-continued

Cas14 Sequences

| SEQ ID NO | Sequence |
|---|---|
| SEQ ID NO: 56 | MTVRTYKYRAYPTPEQAEALTSWLRFASQLYNAALEHRKNAWGRHDAHGRGFRFWD GDAAPRKKSDPPGRWVYRGGGGAHISKNDQGKLLTEFRREHAELLPPGMPALVQHEV LARLERSMAAFFQRATKGQKAGYPRWRSEHRYDSLTFGLTSPSKERFDPETGESLGRG KTVGAGTYHNGDLRLTGLGELRILEHRRIPMGAIPKSVIVRRSGKRWFVSIAMEMPSVE PAASGRPAVGLDMGVVTWGTAFTADTSAAAALVADLRRMATDPSDCRRLEELEREAA QLSEVLAHCRARGLDPARPRRCPKELTKLYRRSLHRLGELDRACARIRRRLQAAHDIAE PVPDEAGSAVLIEGSNAGMRHARRVARTQRRVARRTRAGHAHSNRRKKAVQAYARA KERERSARGDHRHKVSRALVRQFEEISVEALDIKQLTVAPEHNPDPQPDLPAHVQRRRN RGELDAAWGAFFAALDYKAADAGGRVARKPAPHTTQECARCGTLVPKPISLRVHRCP ACGYTAPRTVNSARNVLQRPLEEPGRAGPSGANGRGVPHAVA |
| SEQ ID NO: 57 | MNCRYRYRIYPTPGQRQSLARLFGCVRVVWNDALFLCRQSEKLPKNSELQKLCITQAK KTEARGWLGQVSAIPLQQSVADLGVAFKNFFQSRSGKRKGKKVNPPRVKRRNNRQGA RFTRGGFKVKTSKVYLARIGDIKIKWSRPLPSEPSSVTVIKDCAGQYFLSFVVEVKPEIKP PKNPSIGIDLGLKTFASCSNGEKIDSPDYSRLYRKLKRCQRRLAKRQRGSKRRERMRVK VAKLNAQIRDKRKDFLHKLSTKVVNENQVIALEDLNVGGMLKNRKLSRAISQAGWYE FRSLCEGKAEKHNRDFRVISRWEPTSQVCSECGYRWGKIDLSVRSIVCINCGVEHDRDD NASVNIEQAGLKVGVGHTHDSKRTGSACKTSNGAVCVEPSTHREYVQLTLFDW |
| SEQ ID NO: 58 | MKSRWTFRCYPTPEQEQHLARTFGCVRFVWNWALRARTDAFRAGERIGYPATDKALT LLKQQPETVWLNEVSSVCLQQALRDLQVAFSNFFDKRAAHPSFKRKEARQSANYTERG FSFDHERRILKLAKIGAIKVKWSRKAIPHPSSIRLIRTASGKYFVSLVVETQPAPMPETGE SVGVDFGVARLATLSNGERISNPKHGAKWQRRLAFYQKRLARATKGSKRRMRIKRHV ARIHEKIGNSRSDTLHKLSTDLVTRFDLICVEDLNLRGMVKNHSLARSLHDASIGSAIRM IEEEKAERYGKNVVKIDRWPPSSKTCSDCGHIVEQLPLNVREWTCPECGTTHDRDANAA ANILAVGQTVSAHGGTVRRSRAKASERKSQRSANRQGVNRA |
| SEQ ID NO: 59 | KEPLNIGKTAKAVFKEIDPTSLNRAANYDASIELNCKECKFKPFKNVKRYEFNFYNNWY RCNPNSCLQSTYKAQVRKVEIGYEKLKNEILTQMQYYPWFGRLYQNFFHDERDKMTSL DEIQVIGVQNKVFFNTVEKAWREIIKKRFKDNKETMETIPELKHAAGHGKRKLSNKSLL RRRFAFVQKSFKFVDNSDVSYRSFSNNIACVLPSRIGVDLGGVISRNPKREYIPQEISFNA FWKQHEGLKKGRNIEIQSVQYKGETVKRIEADTGEDKAWGKNRQRRFTSLILKLVPKQ GGKKVWKYPEKRNEGNYEYFPIPIEFILDSGETSIRFGGDEGEAGKQKHLVIPFNDSKAT PLASQQTLLENSRFNAEVKSCIGLAIYANYFYGYARNYVISSIYHKNSKNGQAITAIYLES IAHNYVKAIERQLQNLLLNLRDFSFMESHKKELKKYFGGDLEGTGGAQKRREKEEKIEK EIEQSYLPRLIRLSLTKMVTKQVEM |
| SEQ ID NO: 60 | ELIVNENKDPLNIGKTAKAVFKEIDPTSINRAANYDASIELACKECKFKPFNNTKRHDFS FYSNWHRCSPNSCLQSTYRAKIRTKEIGYEKLKNEILNQMQYYPWFGRLYQNFFNDQR DKMTSLDEIQVTGVQNKIFFNTVEKAWREIIKKRFRDNKETMRTIPDLKNKSGHGSRKL SNKSLLRRRFAFAQKSFKLVDNSDVSYRAFSNNVACVLPSKIGVDIGGIINKDLKREYIP QEITFNVFWKQHDGLKKGRNIEIHSVQYKGEIVKRIEADTGEDKAWGKNRQRRFTSLIL KITPKQGGKKIWKFPEKKNASDYEYFPIPIEFILDNGDASIKFGGEEGEVGKQKHLLIPFN DSKATPLSSKQMLLETSRFNAEVKSTIGLALYANYFVSYARNYVIKSTYHKNSKKGQIV TEIYLESISQNFVRAIQRQLQSLMLNLKDWGFMQTHKKELKKYFGSDLEGSKGGQKRR EKEEKIEKEIEASYLPRLIRLSLTKSVTKAEEM |
| SEQ ID NO: 61 | PEEKTSKLKPNSINLAANYDANEKFNCKECKFHPFKNKKRYEFNFYNNLHGCKSCTKST NNPAVKRIEIGYQKLKFEIKNQMEAYPWFGRLRINFYSDEKRKMSELNEMQVTGVKNK IFFDAIECAWREILKKRFRESKETLITIPKLKNKAGHGARKHRNKKLLIRRRAFMKKNFH FLDNDSISYRSFANNIACVLPSKVGVDIGGIISPDVGKDIKPVDISLNLMWASKEGIKSGR KVEIYSTQYDGNMVKKIEAETGEDKSWGKNRKRRQTSLLLSIPKPSKQVQEFDFKEWP RYKDIEKKVQWRGFPIKIIFDSNHNSIEFGTYQGGKQKVLPIPFNDSKTTPLGSKMNKLE KLRFNSKIKSRLGSAIAANKFLEAARTYCVDSLYHEVSSANAIGKGKIFIEYYLEILSQNY IEAAQKQLQRFIESIEQWFVADPFQGRLKQYFKDDLKRAKCFLCANREVQTTCYAAVK LHKSCAEKVKDKNKELAIKERNNKEDAVIKEVEASNYPRVIRLKLTKTITNKAM |
| SEQ ID NO: 62 | SESENKIIEQYYAFLYSFRDKYEKPEFKNRGDIKRKLQNKWEDFLKEQNLKNDKKLSNY IFSNRNFRRSYDREEENEEGIDEKKSKPKRINCFEKEKNLKDQYDKDAINASANKDGAQ KWGCFECIFFPMYKIESGDPNKRIIINKTRFKLFDFYLNLKGCKSCLRSTYHPYRSNVYIE SNYDKLKREIGNFLQQKNIFQRMRKAKVSEGKYLTNLDEYRLSCVAMHFKNRWLFFDS IQKVLRETIKQRLKQMRESYDEQAKTKRSKGHGRAKYEDQVRMIRRRAYSAQAHKLL DNGYITLFDYDDKEINKVCLTAINQEGFDIGGYLNSDIDNVMPPIEISFHLKWKYNEPILN IESPFSKAKISDYLRKIREDLNLERGKEGKARSKKNVRRKVLASKGEDGYKKIFTDFFSK WKEELEGNAMERVLSQSSGDIQWSKKKRIHYTTLVLNINLLDKKGVGNLKYYEIAEKT KILSFDKNENKFWPITIQVLLDGYEIGTEYDEIKQLNEKTSKQFTIYDPNTKIIKIPFTDSK AVPLGMLGINIATLKTVKKTERDIKVSKIFKGGLNSKIVSKIGKGIYAGYFPTVDKEILEE VEEDTLDNEFSSKSQRNIFLKSIIKNYDKMLKEQLFDFYSFLVRNDLGVRFLTDRELQNI EDESFNLEKRFFETDRDRIARWFDNTNTDDGKEKFKKLANEIVDSYKPRLIRLPVVRVIK RIQPVKQREM |
| SEQ ID NO: | KYSTRDFSELNEIQVTACKQDEFFKVIQNAWREIIKKRFLENRENFIEKKIFKNKKGRGK RQESDKTIQRNRASVMKNFQLIENEKIILRAPSGHVACVFPVKVGLDIGGFKTDDLEKNI |

TABLE 2-continued

Cas14 Sequences

| SEQ ID NO | Sequence |
|---|---|
| SEQ ID NO: 63 | FPPRTITINVFWKNRDRQRKGRKLEVWGIKARTKLIEKVHKWDKLEEVKKKRLKSLEQ KQEEKSLDNWSEVNNDSFYKVQIDELQEKIDKSLKGRTMNKILDNKAKESKEAEGLYIE WEKDFEGEMLRRIEASTGGEEKWGKRRQRRHTSLLLDIKNNSRGSKEIINFYSYAKQGK KEKKIEFFPPPLTITLDAEEESPLNIKSIPIEDKNATSKYFSIPPFTETRATPLSILGDRVQKFK TKNISGAIKRNLGSSISSCKIVQNAETSAKSILSLPNVKEDNNMEIFINTMSKNYFRAMM KQMESFIFEMEPKTLIDPYKEKAIKWFEVAASSRAKRLKKLSKADIKKSELLLSNTEEF EKEKQEKLEALEKEIEEFYLPRIVRLQLTKTILETPVM |
| SEQ ID NO: 64 | KKLQLLGHKILLKEYDPNAVNAAANFETSTAELCGQCKMKPFKNKRRFQYTFGKNYH GCLSCIQNVYYAKKRIVQIAKEELKHQLTDSIASIPYKYTSLFSNTNSIDELYILKQERAA FFSNTNSIDELYITGIENNIAFKVISAIWDEIIKKRRQRYAESLTDTGTVKANRGHGGTAY KSNTRQEKIRALQKQTLHMVTNPYISLARYKNNYIVATLPRTIGMHIGAIKDRDPQKKL SDYAINFNVFWSDDRQLIELSTVQYTGDMVRKIEAETGENNKWGENMKRTKTSLLLEIL TKKTTDELTPKDWAFSTKKEIDSVTKKTYQGFPIGIIFEGNESSVKFGSQNYFPLPFDAKI TPPTAEGFRLDWLRKGSFSSQMKTSYGLAIYSNKVTNAIPAYVIKNMFYKIARAENGKQ IKAKFLKKYLDIAGNNYVPFIIMQHYRVLDTFEEMPISQPKVIRLSLTKTQHIIIKKDKTDS KM |
| SEQ ID NO: 65 | NTSNLINLGKKAINISANYDANLEVGCKNCKFLSSNGNFPRQTNVKEGCHSCEKSTYEP SIYLVKIGERKAKYDVLDSLKKFTFQSLKYQSKKSMKSRNKKPKELKEFVIFANKNKAF DVIQKSYNHLILQIKKEINRMNSKKRKKNHKRRLFRDREKQLNKLRLIESSNLFLPRENK GNNHVFTYVAIHSVGRDIGVIGSYDEKLNFETELTYQLYFNDDKRLLYAYKPKQNKIIKI KEKLWNLRKEKEPLDLEYEKPLNKSITFSIKNDNLFKVSKDLMLRRAKFNIQGKEKLSK EERKINRDLIKIKGLVNSMSYGRFDELKKEKNIWSPHIYREVRQKEIKPCLIKNGDRIEIFE QLKKKMERLRRFREKRQKKISKDLIFAERIAYNFHTKSIKNTSNKINIDQEAKRGKASYM RKRIGYETFKNKYCEQCLSKGNVYRNVQKGCSCFENPFDWIKKGDENLLPKKNEDLRV KGAFRDEALEKQIVKIAFNIAKGYEDFYDNLGESTEKDLKLKFKVGTTINEQESLKL |
| SEQ ID NO: 66 | TSNPIKLGKKAINISANYDSNLQIGCKNCKFLSYNGNFPRQTNVKEGCHSCEKSTYEPPV YTVRIGERRSKYDVLDSLKKFIFLSLKYRQSKKMKTRSKGIRGLEEFVISANLKKAMDVI QKSYRHLILNIKNEIVRMNGKKRNKNHKRLLFRDREKQLNKLRLIEGSSFFKPPTVKGD NSIFTCVAIHNIGRDIGIAGDYFDKLEPKIELTYQLYYEYNPKKESEINKRLLYAYKPKQN KIIIEIKEKLWNLRKEKSPLDLEYEKPLTKSITFLVKRDGVFRISKDLMLRKAKFIIQGKEK LSKEERKINRDLIKIKSNIISLTYGRFDELKKDKTIWSPHIFRDVKQGKITPCIERKGDRMD IFQQLRKKSERLRENRKKRQKKISKDLIFAERIAYNFHTKSIKNTSNLINIKHEAKRGKAS YMRKRIGNETFRIKYCEQCFPKNNVYKNVQKGCSCFEDPFEYIKKGNEDLIPNKNQDLK AKGAFRDDALEKQIIKVAFNIAKGYEDFYENLKKTTEKDIRLKFKVGTIISEEM |
| SEQ ID NO: 67 | NNSINLSKKAINISANYDANLQVRCKNCKFLSSNGNFPRQTDVKEGCHSCEKSTYEPPV YDVKIGEIKAKYEVLDSLKKFTFQSLKYQLSKSMKFRSKKKIKELKEFVIFAKESKALNVI NRSYKHLILNIKNDINRMNSKKRIKNHKGRLFLDRQKQLSKLKLIEGSSFFVPAKNVGN KSVFTCVAIHSIGRDIGIAGLYDSFTKPVNEITYQIFFSGERRLLYAYKPKQLKILSIKENL WSLKNEKKPLDLLYEKPLGKNLNFNVKGGDLFRVSKDLMIRNAKFNVHGRQRLSDEE RLINRNFIKIKGEVVSLSYGRFEELKKDRKLWSPHIFKDVRQNKIKPCLVMQGQRIDIFE QLKRKLELLKKIRKSRQKKLSKDLIFGERIAYNFHTKSIKNTSNKINIDSDAKRGRASYM RKRIGNETFKLKYCDVCFPKANVYRRVQNGCSCSENPYNYIKKGDKDLLPKKDEGLAI KGAFRDEKLNKQIIKVAFNIAKGYEDFYDDLKKRTEKDVDLKFKIGTTVLDQKPMEIFD GIVITWL |
| SEQ ID NO: 68 | LLTTVVETNNLAKKAINVAANFDANIDRQYYRCTPNLCRFIAQSPRETKEKDAGCSSCT QSTYDPKVYVIKIGKLLAKYEILKSLKRFLFMNRYFKQKKTERAQQKQIGTELNEMSIF AKATNAMEVIKRATKHCTYDIIPETKSLQMLKRRRHRVKVRSLLKILKERRMKIKKIPN TFIEIPKQAKKNKSDYYVAAALKSCGIDVGLCGAYEKNAEVEAEYTYQLYYEYKGNSS TKRILYCYNNPQKNIREFWEAFYIQGSKSHVNTPGTIRLKMEKFLSPITIESEALDFRVWN SDLKIRNGQYGFIKKRSLGKEAREIKKGMGDIKRKIGNLTYGKSPSELKSIHVYRTEREN PKKPRAARKKEDNFMEIFEMQRKKDYEVNKKRRKEATDAAKIMDFAEEPIRHYHTNNL KAVRRIDMNEQVERKKTSVFLKRIMQNGYRGNYCRKCIKAPEGSNRDENVLEKNEGCL DCIGSEFIWKKSSKEKKGLWHTNRLLRRIRLQCFTTAKAYENFYNDLFEKKESSLDIIKL KVSITTKSM |
| SEQ ID NO: 69 | ASTMNLAKQAINFAANYDSNLEIGCKGCKFMSTWSKKSNPKFYPRQNNQANKCHSCT YSTGEPEVPIIEIGERAAKYKIFTALKKFVFMSVAYKERRRQRFKSKKPKELKELAICSNR EKAMEVIQKSVVHCYGDVKQEIPRIRKIKVLKNHKGRLFYKQKRSKIKIAKLEKGSFFK TFIPKVHNNGCHSCHEASLNKPILVTTALNTIGADIGLINDYSTIAPTETDISWQVYYEFIP NGDSEAVKKRLLYFYKPKGALIKSIRDKYFKKGHENAVNTGFFKYQGKIVKGPIKFVNN ELDFARKPDLKSMKIKRAGFAIPSAKRLSKEDREINRESIKIKNKIYSLSYGRKKTLSDKD IIKKHLYRPVRQKGVKPLEYRKAPDGFLEFFYSLKRKERRLRQKEKRQKDMSEIIDAAD EFAWHRHTGSIKKTTNHINFKSEVKRGKVPIMKKRIANDSFNTRHCGKCVKQGNAINK YYIEKQKNCFDCNSIEFKWEKAALEKKGAFKLNKRLQYIVKACFNVAKAYESFYEDFR KGEEESLDLKFKIGTTTTLKQYPQNKARAM |

TABLE 2-continued

Cas14 Sequences

| SEQ ID NO | Sequence |
|---|---|
| SEQ ID NO: 70 | HSHNLMLTKLGKQAINFAANYDANLEIGCKNCKFLSYSPKQANPKKYPRQTDVHEDGN IACHSCMQSTKEPPVYIVPIGERKSKYEILTSLNKFTFLALKYKEKKRQAFRAKKPKELQ ELAIAFNKEKAIKVIDKSIQHLILNIKPEIARIQRQKRLKNRKGKLLYLHKRYAIKMGLIK NGKYFKVGSPKKDGKKLLVLCALNTIGRDIGIIGNIEENNRSETEITYQLYFDCLDANPN ELRIKEIEYNRLKSYERKIKRLVYAYKPKQTKILEIRSKFFSKGHENKVNTGSFNFENPLN KSISIKVKNSAFDFKIGAPPFIMLRNGKFHIPTKKRLSKEEREINRTLSKIKGRVFRLTYGRN ISEQGSKSLHIYRKERQHPKLSLEIRKQPDSFIDEFEKLRLKQNFISKLKKQRQKKLADLL QFADRIAYNYHTSSLEKTSNFINYKPEVKRGRTSYIKKRIGNEGFEKLYCETCIKSNDKE NAYAVEKEELCFVCKAKPFTWKKTNKDKLGIFKYPSRIKDFIRAAFTVAKSYNDFYENL KKKDLKNEIFLKFKIGLILSHEKKNHISIAKSVAEDERISGKSIKNILNKSIKLEKNCYSCFF HKEDM |
| SEQ ID NO: 71 | SLERVIDKRNLAKKAINIAANFDANINKGFYRCETNQCMFIAQKPRKTNNTGCSSCLQST YDPVIYVVKVGEMLAKYEILKSLKRFVFMNRSFKQKKTEKAKQKERIGGELNEMSIFA NAALAMGVIKRAIRHCHVDIRPEINRLSELKKTKHRVAAKSLVKIVKQRKTKWKGIPNS FIQIPQKARNKDADFYVASALKSGGIDIGLCGTYDKKPHADPRWTYQLYFDTEDESEKR LLYCYNDPQAKIRDFWKTFYERGNPSMVNSPGTIEFRMEGFFEKMTPISIESKDFDFRV WNKDLLIRRGLYEIKKRKNLNRKAREIKKAMGSVKRVLANMTYGKSPTDKKSIPVYRV EREKPKKPRAVRKEENELADKLENYRREDFLIRNRRKREATEIAKIIDAAEPPIRHYHTN HLRAVKRIDLSKPVARKNTSVFLKRIMQNGYRGNYCKKCIKGNIDPNKDECRLEDIKKC ICCEGTQNIWAKKEKLYTGRINVLNKRIKQMKLECFNVAKAYENFYDNLAALKEGDLK VLKLKVSIPALNPEASDPEEDM |
| SEQ ID NO: 405 | NASINLGKRAINLSANYDSNLVIGCKNCKFLSFNGNFPRQTNVREGCHSCDKSTYAPEV YIVKIGERKAKYDVLDSLKKFTFQSLKYQIKKSMRERSKKPKELLEFVIFANKDKAFNVI QKSYEHLILNIKQEINRMNGKKRIKNHKKRLFKDREKQLNKLRLIGSSSLFFPRENKGDK DLFTYVAIHSVGRDIGVAGSYESHIEPISDLTYQLFINNEKRLLYAYKPKQNKIIELKENL WNLKKEKKPLDLEFTKPLEKSITFSVKNDKLFKVSKDLMLRQAKFNIQGKEKLSKEERQ INRDFSKIKSNVISLSYGRFEELKKEKNIWSPHIYREVKQKEIKPCIVRKGDRIELFEQLKR KMDKLKKFRKERQKKISKDLNFAERIAYNFHTKSIKNTSNKINIDQEAKRGKASYMRKR IGNESFRKKYCEQCFSVGNVYHNVQNGCSCFDNPIELIKKGDEGLIPKGKEDRKYKGAL RDDNLQMQIIRVAFNIAKGYEDFYNNLKEKTEKDLKLFKIGTTISTQESNNKEM |
| SEQ ID NO: 72 | SNLIKLGKQAINFAANYDANLEVGCKNCKFLSSTNKYPRQTNVHLDNKMACRSCNQST MEPAIYIVRIGEKKAKYDIYNSLTKFNFQSLKYKAKRSQRFKPKQPKELQELSIAVRKEK ALDIIQKSIDHLIQDIRPEIPRIKQQKRYKNHVGKLFYLQKRRKNKLNLIGKGSFFKVFSP KEKKKNELLVICALTNIGRDIGLIGNYNTIINPLFEVTYQLYYDYIPKKNNKNVQRRLLYA YKSKNEKILKLKEAFFKRGHENAVNLGSFSYEKPLEKSLTLKIKNDKDDFQVSPSLRIRT GRFFVPSKRNLSRQEREINRRLVKIKSKIKNMTYGKFETARDKQSVHIFRLERQKEKLPL QFRKDEKEFMEEFQKLKRRTNSLKKLRKSRQKKLADLLQLSEKVVYNNHTGTLKKTSN FLNFSSSVKRGKTAYIKELLGQEGFETLYCSNCINKGQKTRYNIETKEKCFSCKDVPFVW KKKSTDKDRKGAFLFPAKLKDVIKATFTVAKAYEDFYDNLKSIDEKKPYIKFKIGLILAH VRHEHKARAKEEAGQKNIYNKPIKIDKNCKECFFFKEEAM |
| SEQ ID NO: 73 | NTTRKKFRKRTGFPQSDNIKLAYCSAIVRAANLDADIQKKHNQCNPNLCVGIKSNEQSR KYEHSDRQALLCYACNQSTGAPKVDYIQIGEIGAKYKILQMVNAYDFLSLAYNLTKLR NGKSRGHQRMSQLDEVVIVADYEKATEVIKRSINHLLDDIRGQLSKLKKRTQNEHITEH KQSKIRRKLRKLSRLLKRRRWKWGTIPNPYLKNWVFTKKDPELVTVALLHKLGRDIGL VNRSKRRSKQKLLPKVGFQLYYKWESPSLNNIKKSKAKKLPKRLLIPYKNVKLFDNKQ KLENAIKSLLESYQKTIKVEFDQFFQNRTEEIIAEEQQTLERGLLKQLEKKKNEFASQKK ALKEEKKKIKEPRKAKLLMEESRSLGFLMANVSYALFNTTIEDLYKKSNVVSGCIPQEP VVVFPADIQNKGSLAKILFAPKDGFRIKFSGQHLTIRTAKFKIRGKEIKILTKTKREILKNI EKLRRVWYREQHYKLKLFGKEVSAKPRFLDKRKTSIERRDPNKLADQTDDRQAELRNK EYELRHKQHKMAERLDNIDTNAQNLQTLSFWVGEADKPPKLDEKDARGFGVRTCISA WKWFMEDLLKKQEEDPLLKLKLSIM |
| SEQ ID NO: 74 | PKKPKFQKRTGFPQPDNLRKEYCLAIVRAANLDADFEKKCTKCEGIKTNKKGNIVKGRT YNSADKDNLLCYACNISTGAPAVDYVFVGALEAKYKILQMVKAYDPHSLAYNLAKLW KGRGRGHQRMGGLNEVVIVSNNEKALDVIEKSLNHFPHDEIRGELSRLKAKFQNEHLHV HKESKLRRKLRKISRLLKRRRWKWDVIPNSYLRNFTFTKTRPDFISVALLHRVGRDIGLV TKTKIPKPTDLLPQFGFQIYYTWDEPKLNKLKKSRLRSEPKRLLKPYKIELYKNKSVLE EAIRHLAEVYTEDLTICFKDFFETQKRKFVSKEKESLKRELLKELTKLKKDFSERKTALK RDRKEIKEPKKAKLLMEESRSLGFLAANTSYALFNLIAADLYTKSKKACSTKLPRQLSTI LPLEIKEHKSTTSLAIKPEEGFKIRFSNTHLSIRTPKFKMKGADIKALTKRKREILKNATKL EKSWYGLKHYKLKLYGKEVAAKPRFLDKRNPSIDRRDPKELMEQIENRRNEVKDLEYE IRKGQHQMAKRLDNVDTNAQNLQTKSFWVGEADKPPELDSMEAKKLGLRTCISAWK WFMKDLVLLQEKSPNLKLKLSLTEM |
| SEQ ID NO: 75 | KFSKRQEGFLIPDNIDLYKCLAIVRSANLDADVQGHKSCYGVKKNGTYRVKQNGKKGV KEKGRKYVFDLIAFKGNIEKIPHEAIEEKDQGRVIVLGKFNYKLILNIEKNHNDRASLEIK NKIKKLVQISSLETGEFLSDLLSGKIGIDEVYGIIEPDVFSGKELVCKACQQSTYAPLVEY MPVGELDAKYKILSAIKGYDFLSLAYNLSRNRANKKRGHQKLGGGELSEVVISANYDK ALNVIKRSINHYHVEIKPEISKLKKKMQNEPLKVMKQARIRRELHQLSRVKRLKWKW GMIPNPELQNIIFEKKEKDFVSYALLHTLGRDIGLFKDTSMLQVPNISDYGFQIYYSWED |

TABLE 2-continued

Cas14 Sequences

| SEQ ID NO | Sequence |
|---|---|
| | PKLNSIKKIKDLPKRLLIPYKRLDFYIDTILVAKVIKNLIELYRKSYVYETFGEEYGYAKK<br>AEDILFDWDSINLSEGIEQKIQKIKDEFSDLLYEARESKRQNFVESFENILGLYDKNFASD<br>RNSYQEKIQSMIIKKQQENIEQKLKREFKEVIERGFEGMDQNKKYYKVLSPNIKGGLLY<br>TDTNNLGFFRSHLAFMLLSKISDDLYRKNNLVSKGGNKGILDQTPETMLTLEFGKSNLP<br>NISIKRKFFNIKYNSSWIGIRKPKFSIKGAVIREITKKVRDEQRLIKSLEGVWHKSTHFKR<br>WGKPRFNLPRHPDREKNNDDNLMESITSRREQIQLLLREKQKQQEKMAGRLDKIDKEIQ<br>NLQTANFQIKQIDKKPALTEKSEGKQSVRNALSAWKWFMEDLIKYQKRTPILQLKLAK<br>M |
| SEQ ID NO: 76 | KFSKRQEGFVIPENIGLYKCLAIVRSANLDADVQGHVSCYGVKKNGTYVLKQNGKKSI<br>REKGRKYASDLVAFKGDIEKIPFEVIEEKKKEQSIVLGKFNYKLVLDVMKGEKDRASLT<br>MKNKSKKLVQVSSLGTDEFLLTLLNEKFGIEEIYGIIEPEVFSGKKLVCKACQQSTYAPL<br>VEYMPVGELDSKYKILSAIKGYDFLSLAYNLARHRSNKKRGHQKLGGGELSEVVISAN<br>NAKALNVIKRSLNHYYSEIKPEISKLRKKMQNEPLKVGKQARMRRELHQLSRKVKRLK<br>WKWGKIPNLELQNITFKESDRDFISYALLHTLGRDIGMFNKTEIKMPSNILGYGFQIYYD<br>WEEPKLNTIKKKSKNTPKRILIPYKKLDFYNDSILVARAIKELVGLFQESYEWEIFGNEYN<br>YAKEAEVELIKLDEESINGNVEKKLQRIKENFSNLLEKAREKKRQNFIESFESIARLYDES<br>FTADRNEYQREIQSFIIEKQKQSIEKKLKNEFKKIVEKKFNEQEQGKKHYRVLNPTIINEF<br>LPKDKNNLGFLRSKIAFILLSKISDDLYKKSNAVSKGGEKGIIKQQPETILDLEFSKSKLPS<br>INIKKKLFNIKYTSSWLGIRKPKFNIKGAKIREITRRVRDVQRTLKSAESSWYASTHFRR<br>WGFPRFNQPRHPDKEKKSDDRLIESITLLREQIQILLREKQKGQKEMAGRLDDVDKKIQ<br>NLQTANFQIKQTGDKPALTEKSAGKQSFRNALSAWKWFMENLLKYQNKTPDLKLKIA<br>RTVM |
| SEQ ID NO: 77 | KWIEPNNIDFNKCLAITRSANLDADVQGHKMCYGIKTNGTYKAIGKINKKHNTGIIEKR<br>RTYVYDLIVTKEKNEKIVKKTDFMAIDEEIEFDEKKEKLLKKYIKAEVLGTGELIRKDLN<br>DGEKFDDLCSIEEPQAFRRSELVCKACNQSTYASDIRYIPIGEIEAKYKILKAIKGYDFLSL<br>KYNLGRLRDSKKRGHQKMGQGELKEFVICANKEKALDVIKRSLNHYLNEVKDEISRLN<br>KKMQNEPLKVNDQARWRRELNQISRRLKRLWKWGEIPNPELKNLIFKSSRPEFVSYA<br>LIHTLGRDIGLINETELKPNNIQEYGFQIYYKWEDPELNHIKKVKNIPKRFIIPYKNLDLFG<br>KYTILSRAIEGILKLYSSSFQYKSFKDPNLFAKEGEKKITNEDFELGYDEKIKKIKDDFKS<br>YKKALLEKKKNTLEDSLNSILSVYEQSLLTEQINNVKKWKEGLLKSKESIHKQKKIENIE<br>DIISRIEELKNVEGWIRTKERDIVNKEETNLKREIKKELKDSYYEEVRKDFSDLKKGEESE<br>KKPFREEPKPIVIKDYIKFDVLPGENSALGFFLSHLSFNLFDSIQYELFEKSRLSSSKHPQIP<br>ETILDL |
| SEQ ID NO: 78 | FRKFVKRSGAPQPDNLNKYKCIAIVRAANLDADIMSNESSNCVMCKGIKMNKRKTAKG<br>AAKTTELGRVYAGQSGNUCTACTKSTMGPLVDYVPIGRIRAKYTILRAVKEYDFLSLA<br>YNLARTRVSKKGGRQKMHSLSELVIAAEYEIAWNIIKSSVIHYHQETKEEISGLRKKLQA<br>EHIHKNKEARIRREMHQISRRIKRLKWKWHMIPNSELHNFLFKQQDPSFVAVALLHTLG<br>RDIGMINKPKGSAKREFIPEYGFQIYYKWMNPKLNDINKQKYRKMPKRSLIPYKNLNVF<br>GDRELIENAMHKLLKLYDENLEVKGSKFFKTRVVAISSKESEKLKRDLLWKGELAKIKK<br>DFNADKNKMQELFKEVKEPKKANALMKQSRNMGFLLQNISYGALGLLANRMYEASA<br>KQSKGDATKQPSIVIPLEMEFGNAFPKLLLRSGKFAMNVSSPWLTIRKPKFVIKGNKIKN<br>ITKLMKDEKAKLKRLETSYHRATHFRPTLRGSIDWDSPYFSSPKQPNTHRRSPDRLSADI<br>TEYRGRLKSVEAELREGQRAMAKKLDSVDMTASNLQTSNFQLEKGEDPRLTEIDEKGR<br>SIRNCISSWKKFMEDLMKAQEANPVIKIKIALKDESSVLSEDSM |
| SEQ ID NO: 79 | KFHPENLNKSYCLAIVRAANLDADIQGHINCIGIKSNKSDRNYENKLESLQNVELLCKA<br>CTKSTYKPNINSVPVGEKKAKYSILSEIKKYDFNSLVYNLKKYRKGKSRGHQKLNELRE<br>LVITSEYKKALDVINKSVNHYLVNIKNKMSLKKKILQNEHIHVGTLARIRRERNRISRKL<br>DHYRKKWKFVPNKILKNYVFKNQSPDFVSVALLHKLGRDIGLITKTAILQKSFPEYSLQ<br>LYYKYDTPKLNYLKKSKFKSLPKRILISYKYPKFDINSNYIEESIDKLLKLYEESPIYKNNS<br>KIIEFFKKSEDNLIKSENDSLKRGIMKEFEKVTKNFSSKKKKLKEELKLKNEDKNSKMLA<br>KVSRPIGFLKAYLSYMLFNIISNRIFEFSRKSSGRIPQLPSCIINLGNQFENFKNLEQDSNIG<br>SKKNYKYFCNLLLKSSGFNISYEEEHLSIKTPNFFINGRKLKEITSEKKKIRKENEQLIKQ<br>WKKLTFFKPSNLNGKKTSDKIRFKSPNNPDIERKSEDNIVENIAKVKYKLEDLLSEQRKE<br>FNKLAKKHDGVDVEAQCLQTKSFWIDSNSPIKKSLEKKNEKVSVKKKMKAIRSCISAW<br>KWFMADLIEAQKETPMIKLKLALM |
| SEQ ID NO: 80 | TTLVPSHLAGIEVMDETTSRNEDMIQKETSRSNEDENYLGVKNKCGINVHKSGRGSSKH<br>EPNMPPEKSGEGQMPKQDSTEMQQRFDESVTGETQVSAGATASIKTDARANSGPRVGT<br>ARALIVKASNLDRDIKLGCKPCEYIRSELPMGKKNGCNHCEKSSDIASVPKVESGFRKA<br>KYELVRRFESFAADSISRHLGKEQARTGRKGKKDKKEQMGKVNLDEIAILKNESLIEY<br>TENQILDARSNRIKEWLRSLRLRLRTRNKGLKKSKSIRRQLITLRRDYRKWIKPNPYRPD<br>EDPNENSLRLHTKLGVDIGVQGGDNKRMNSDDYETSFSITWRDTATRKICFTKPKGLLP<br>RHMKFKLRGYPELILYNEELRIQDSQKFPLVDWERIPIFKLRGVSLGKKKVKALNRITEA<br>PRLVVAKRIQVNIESKKKKVLTRYVYNDKSINGRLVKAEDSNKDPLLEFKKQAEEINSD<br>AKYYENQEIAKNYLWGCEGLHKNLLEEQTKNPYLAFKYGFLNIV |
| SEQ ID NO: 81 | LDFKRTCSQELVLLPEIEGLKLSGTQGVTSLAKKLINKAANVDRDESYGCHHCIHTRTSL<br>SKPVKKDCNSCNQSTNHPAVPITLKGYKIAFYELWHRFTSWAVDSISKALHRNKVMGK<br>VNLDEYAVVSNSHIVCYAVRKCYEKQRSVRLHKRAYRCRAKHYNKSQPKVGRIYKK<br>SKRRNARNLKKEAKRYFQPNEITNGSSDALFYKIGVDLGIAKGTPETEVKVDVSICFQV |

TABLE 2-continued

Cas14 Sequences

| SEQ ID NO | Sequence |
|---|---|
| | YYGDARRVLRVRKMDELQSFHLDYTGKLKLKGIGNKDTFTIAKRNESLKWGSTKYEVS<br>RAHKKFKPFGKKGSVKRKCNDYFRSIASWSCEAASQRAQSNLKNAFPYQKALVKCYK<br>NLDYKGVKKNDMWYRLCSNRIFRYSRIAEDIAQYQSDKGKAKFEFVILAQSVAEYDISA<br>IM |
| SEQ ID NO: 82 | VFLTDDKRKTALRKIRSAFRKTAEIALVRAQEADSLDRQAKKLTIETVSFGAPGAKNAFI<br>GSLQGYNWNSHRANVPSSGSAKDVFRITELGLGIPQSAHEASIGKKSFELVGNVVRYTAN<br>LLSKGYKKGAVNKGAKQQREIKGKEQLSFDLISNGPISGDKLINGQKDALAWWLIDKM<br>GFHIGLAMEPLSSPNTYGITLQAFWKRHTAPRRYSRGVIRQWQLPFGRQLAPLIHNFFRK<br>KGASIPIVLTNASKKLAGKGVLLEQTALVDPKKWWQVKEQVTGPLSNIWERSVPLVLY<br>TATFTHKHGAAHKRPLTLKVIRISSGSVFLLPLSKVTPGKLVRAWMPDINILRDGRPDEA<br>AYKGPDLIRARERSFPLAYTCVTQIADEWQKRALESNRDSITPLEAKLVTGSDLLQIHST<br>VQQAVEQGIGGRISSPIQELLAKDALQLVLQQLFMTVDLLRIQWQLKQEVADGNTSEK<br>AVGWAIRISNIHKDAYKTAIEPCTSALKQAWNPLSGFEERTFQLDASIVRKRSTAKTPDD<br>ELVIVLRQQAAEMTVAVTQSVSKELMELAVRHSATLHLLVGEVASKQLSRSADKDRG<br>AMDHWKLLSQSM |
| SEQ ID NO: 83 | EDLLQKALNTATNVAAIERHSCISCLFTESEIDVKYKTPDKIGQNTAGCQSCTFRVGYSG<br>NSHTLPMGNRIALDKLRETIQRYAWHSLLFNVPPAPTSKRVRAISELRVAAGRERLFTVI<br>TFVQTNILSKLQKRYAANWTPKSQERLSRLREEGQHILSLLESGSWQQKEVVREDQDLI<br>VCSALTKPGLSIGAFCRPKYLKPAKHALVLRLIFVEQWPGQIWGQSKRTRRMRRRKDV<br>ERVYDISVQAWALKGKETRISECIDTMRRHQQAYIGVLPFLILSGSTVRGKGDCPILKEIT<br>RMRYCPNNEGLIPLGIFYRGSANKLLRVVKGSSFTLPMWQNIETLPHPEPFSPEGWTATG<br>ALYEKNLAYWSALNEAVDWYTGQILSSGLQYPNQNEFLARLQNVIDSIPRKWFRPQGL<br>KNLKPNGQEDIVPNEFVIPQNAIRAHHVIEWYHKTNDLVAKTLLGWGSQTTLNQTRPQ<br>GDLRFTYTRYYFREKEVPEV |
| SEQ ID NO: 84 | VPKKKLMRELAKKAVFEAIFNDPIPGSFGCKRCTLIDGARVTDAIEKKQGAKRCAGCEP<br>CTFHTLYDSVKHALPAATGCDRTAIDTGLWEILTALRSYNWMSFRRNAVSDASQKQV<br>WSIEELAIWADKERALRVILSALTHTIGKLKNGFSRDGVWKGGKQLYENLAQKDLAKG<br>LFANGEIFGKELVEADHDMLAWTIVPNHQFHIGLIRGNWKPAAVEASTAFDARWLTNG<br>APLRDTRTHGHRGRRFNRTEKLTVLCIKRDGGVSEEFRQERDYELSVMLLQPKNKLKPE<br>PKGELNSFEDLHDHWWFLKGDEATALVGLTSDPTVGDFIQLGLYIRNPIKAHGETKRRL<br>LICFEPPIKLPLRRAFPSEAFKTWEPTINVFRNGRRDTEAYYDIDRARVFEFPETRVSLEH<br>LSKQWEVLRLEPDRENTDPYEAQQNEGAELQVYSLLQEAAQKMAPKVVIDPFGQFPLE<br>LFSTFVAQLFNAPLSDTKAKIGKPLDSGFVVESHLHLLEEDFAYRDFVRVTFMGTEPTFR<br>VIHYSNGEGYWKKTVLKGKNNIRTALIPEGAKAAVDAYKNKRCPLTLEAAILNEEKDR<br>RLVLGNKALSLLAQTARGNLTILEALAAEVLRPLSGTEGVVHLHACVTRHSTLTESTET<br>DNM |
| SEQ ID NO: 85 | VEKLFSERLKRAMWLKNEAGRAPPAETLTLKHKRVSGGHEKVKEELQRVLRSLSGTNQ<br>AAWNLGLSGGREPKSSDALKGEKSRVVLETVVFHSGHNRVLYDVIEREDQVHQRSSIM<br>HMRRKGSNLLRLWGRSGKVRRKMREEVAEIKPVWHKDSRWLAIVEEGRQSVVGISSA<br>GLAVFAVQESQCTTAEPKPLEYVVSIWFRGSKALNPQDRYLEFKKLKTTEALRGQQYD<br>PIPFSLKRGAGCSLAIRGEGIKFGSRGPIKQFFGSDRSRPSHADYDGKRRLSLFSKYAGDL<br>ADLTEEQWNRTVSAFAEDEVRRATLANIQDFLSISHEKYAERLKKRIESIEEPVSASKLE<br>AYLSAIFETFVQQREALASNFLMRLVESVALLISLEEKSPRVEFRVARYLAESKEGFNRK<br>AM |
| SEQ ID NO: 86 | VVITQSELYKERLLRVMEIKNDRGRKEPRESQGLVLRFTQVTGGQEKVKQKLWLIFEGF<br>SGTNQASWNFGQPAGGRKPNSGDALKGPKSRVTYETVVFHFGLRLLSAVIERHNLKQQ<br>RQTMAYMKRRAAARKKWARSGKKCSRMRNEVEKIKPKWHKDPRWFDIVKEGEPSIV<br>GISSSAGFAIYIVEEPNFPRQDPLEIEYAISIWFRRDRSQYLTFKKIQKAEKLKELQYNPIPFR<br>LKQEKTSLVFESGDIKFGSRGSIEHFRDEARGKPPKADMDNNRRLTMFSVFSGNLTNLT<br>EEQYARPVSGLLAPDEKRMPTLLKKLQDFFTPIHEKYGERIKQRLANSEASKRPFKKLEE<br>YLPAIYLEFRARREGLASNWVLVLINSVRTLVRIKSEDPYIEFKVSQYLLEKEDNKAL |
| SEQ ID NO: 87 | KQDALFEERLKKAIFIKRQADPLQREELSLLPPNRKIVTGGHESAKDTLKQILRAINGTN<br>QASWNPGTPSGKRDSKSADALAGPKSRVKLETVVFPHVGHRLLKKVVEYQGHQKQQH<br>GLKAFMRTCAAMRKKWKRSGKVVGELREQLANIQPKWHYDSRPLNLCFEGKPSVVGL<br>RSAGIALYTIQKSVVPVKEPKPIEYAVSIWFRGPKAMDREDFCLEFKKLKIATELRKLQF<br>EPIVSTLTQGIKGFSLYIQGNSVKFGSRGPIKYFSNESVRQRPPKADPDGNKRLALFSKFS<br>GDLSDLTEEQWNRPILAFEGIIRRATLGNIQDYLTVGHEQFAISLEQLLSEKESVLQMSIE<br>QQRLKKNLGKKAENEWVESFGAEQARKKAQGIREYISGFFQEYCSQREQWAENWVQQ<br>LNKSVRLFLTIQDSTPFIEFRVARYLPKGEKKKGKAM |
| SEQ ID NO: 88 | ANHAERHKRLRKEANRAANRNRPLVADCDTGDPLVGICRLLRRGDKMQPNKTGCRSC<br>EQVEPELRDAILVSGPGRLDNYKYELFQRGRAMAVHRLLKRVPKLNRPKKAAGNDEK<br>KAENKKSEIQKEKQKQRRMMPAVSMKQVSVADFKHVIENTVRHLFGDRRDREIAECA<br>ALRAASKYFLKSRRVRPRKLPKLANPDHGKELKGLRLREKRAKLKKEKEKQAELARSN<br>QKGAVLHVATLKKDAPPMPYEKTQGRNDYTTFVISAAIKVGATRGTKPLLTPQPREWQ<br>CSLYWRDGQRWIRGGLLGLQAGIVLGPKLNRELLEAVLQRPIECRMSGCGNPLQVRGA<br>AVDFFMTTNPYVSGAAYQKKFKPFGTKRASEDGAAAKAREKLMTQLAKVLDKVVT<br>QAAHSPLDGIWETRPEAKLRAMIMALEHEWIFLRPGPCHNAAEEVIKCDCTGGHAILW |

TABLE 2-continued

Cas14 Sequences

| SEQ ID NO | Sequence |
|---|---|
| | ALIDEARGALEHKEFYAVTRAHTHDCEKQKLGGRLAGFLDLLIAQDVPLDDAPAARKI KTLLEATPPAPCYKAATSIATCDCEGKFDKLWAIIDATRAGHGTEDLWARTLAYPQNV NCKCKAGKDLTHRLADFLGLLIKRDGPFRERPPHKVTGDRKLVFSGDKKCKGHQYVIL AKAHNEEVVRAWISRWGLKSRTNKAGYAATELNLLLNWLSICRRRWMDMLTVQRDT PYIRMKTGRLVVDDKKERKAM |
| SEQ ID NO: 89 | AKQREALRVALERGIVRASNRTYTLVTNCTKGGPLPEQCRMIERGKARAMKWEPKLV GCGSCAAATVDLPAIEEYAQPGRLDVAKYKLTTQILAMATRRMMVRAAKLSRRKGQW PAKVQEEKEEPPEPKKMLKAVEMRPVAIVDFNRVIQTTIEHLWAERANADEAELKALK AAAAYFGPSLKIRARGPPKAAIGRELKKAHRKKAYAERKKARRKRAELARSQARGAA AHAAIRERDIPPMAYERTQGRNDVTTIPIAAAIKIAATRGARPLPAPKPMKWQCSLYWN EGQRWIRGGMLTAQAYAHAANIHRPMRCEMWGVGNPLKVRAFEGRVADPDGAKGR KAEFRLQTNAFYVSGAAYRNKKFKPFGTDRGGIGSARKKRERLMAQLAKILDKVVSQA AHSPLDDIWHTRPAQKLRAMIKQLEHEWMFLRPQAPTVEGTKPDVDVAGNMQRQIKA LMAPDLPPIEKGSPAKRFTGDKRKKGERAVRVAEAHSDEVVTAWISRWGIQTRRNEGS YAAQELELLLNWLQICRRRWLDMTAAQRVSPYIRMKSGRMITDAADEGVAPIPLVENM |
| SEQ ID NO: 90 | KSISGRSIKHMACLKDMLKSEITEIEEKQKKESLRKWDYYSKFSDEILFRRNLNVSANHD ANACYGCNPCAFLKEVYGFRIERRNNERIISYRRGLAGCKSCVQSTGYPPIEFVRRKFGA DKAMEIVREVLHRRNWGALARNIGREKEADPILGELNELLLVDARPYFGNKSAANETN LAFNVITRAAKKFRDEGMYDIHKQLDIHSEEGKVPKGRKSRLIRIERKHKAIHGLDPGET WRYPHCGKGEKYGVWLNRSRLIHIKGNEYRCLTAFGTTGRRMSLDVACSVLGHPLVK KKRKKGKKTVDGTELWQIKKATETLPEDPIDCTFYLYAAKPTKDPFILKVGSLKAPRW KKLHKDFFEYSDTEKTQGQEKGKRVVRRGKVPRILSLRPDAKFKVSIWDDPYNGKNNE GTLLRMELSGLDGAKKPLILKRYGEPNTKPKNFVFWRPHITPHPLTFTPKHDFGDPNKK TKRRRVFNREYYGHLNDLAKMEPNAKFFEDREVSNKKNPKAKNIRIQAKESLPNIVAK NGRWAAFDPNDSLWKLYLHWRGRRKTIKGGISQEFQEFKERLDLYKKHEDESEWKEK EKLWENHEKEWKKTLEIHGSIAEVSQRCVMQSMMGPLDGLVQKKDYVHIGQSSLKAA DDAWTFSANRYKKATGPKWGKISVSNLLYDANQANAELISQSISKYLSKQKDNQGCEG RKMKFLIKIIEPLRENFVKHTRWLHEMTQKDCEVRAQFSRVSM |
| SEQ ID NO: 91 | FPSDVGADALKHVRMLQPRLTDEVRKVALTRAPSDRPALARFAAVAQDGLAFVRHLN VSANHDSNCTFPRDPRDPRRGPCEPNPCAFLREVWGFRIVARGNERALSYRRGLAGCKS CVQSTGFPSVPFHRIGADDCMRKLHEILKARNWRLLARNIGREREADPLLTELSEYLLV DARTYPDGAAPNSGRLAENVIKRAAKKFRDEGMRDIHAQLRVHSREGKVPKGRLQRL RRIERKHRAIHALDPGPSWEAEGSARAEVQGVAVYRSQLLRVGHHTQQIEPVGIVARTL FGVGRTDLDVAVSVLGAPLTKRKKGSKTLESTEDFRIAKARETRAEDKIEVAFVLYPTA SLLRDEIPKDAFPAMRIDRFLLKVGSVQADREILLQDDYYRFGDAEVKAGKNKGRTVT RPVKVPRLQALRPDAKFRVNVWADPFGAGDSPGTLLRLEVSGVTRRSQPLRLLRYGQP STQPANFLCWRPHRVPDPMTFTPRQKFGERRKNRRTRRPRVFERLYQVHIKHLAHLEPN RKWFEEARVSAQKWAKARAIRRKGAEDIPVVAPPAKRRWAALQPNAELWDLYAHDR EARKRFRGGRAAEGEEFKPRLNLYLAHEPEAEWESKRDRWERYEKKWTAVLEEHSRM CAVADRTLPQFLSDPLGARMDDKDYAFVGKSALAVAEAFVEEGTVERAQGNCSITAK KKFASNASRKRLSVANLLDVSDKADRALVFQAVRQYVQRQAENGGVEGRRMAFLRK LLAPLRQNFVCHTRWLHM |
| SEQ ID NO: 92 | AARKKKRGKIGITVKAKEKSPPAAGPFMARKLVNVAANVDGVEVHLCVECEADAHGS ASARLLGGCRSCTGSIGAEGRLMGSVDVDRERVIAEPVHTETERLGPDVKAFEAGTAES KYAIQRGLEYWGVDLISRNRARTVRKMEEADRPESSTMEKTSWDEIAIKTYSQAYHAS ENHLFWERQRRVRQHALALFRRARERNRGESPLQSTQRPAPLVLAALHAEAAAISGRA RAEYVLRGPSANVRAAAADIDAKPLGHYKTPSPKVARGFPVKRDLLRARHRIVGLSRA YFKPSDVVRGTSDAIAHVAGRNIGVAGGKPKEIEKTFTLPFVAYWEDVDRVVHCSSFK ADGPWVRDQRIKIRGVSSAVGTFSLYGLDVAWSKPTSFYIRCSDIRKKFHPKGFGPMKH WRQWAKELDRLTEQRASCVVRALQDDEELLQTMERGQRYYDVFSCAATHATRGEAD PSGGCSRCELVSCGVAHKVTKKAKGDTGIEAVAVAGCSLCESKLVGPSKPRVHRQMA ALRQSHALNYLRRLQREWEALEAVQAPTPYLRFKYARHLEVRSM |
| SEQ ID NO: 93 | AAKKKKQRGKIGISVKPKEGSAPPADGPFMARKLVNVAANVDGVEVNLCIECEADAH GSAPARLLGGCKSCTGSIGAEGRLMGSVDVDRADAIAKPVNTETEKLGPDVQAFEAGT AETKYALQRGLEYWGVDLISRNRSRTVRRTEEGQPESATMEKTSWDEIAIKSYTRAYH ASENHLFWERQRRVRQHALALFKRAKERNRGDSTLPREPGHGLVAIAALACEAYAVG GRNLAETVVRGPTFGTARAVRDVEIASLGRYKTPSPKVAHGSPVKRDFLRARHRIVGLA RAYYRPSDVVRGTSDAIAHVAGRNIGVAGGKPRAVEAVFTLPFVAYWEDVDRVVHCS SFQVSAPWNRDQRMKIAGVTTAAGTFSLHGGELKWAKPTSFYIRCSDTRRKFRPKGFG PMKRWRQWAKDLDRLVEQRASCVVRALQDDAALLETMERGQRYYDVFACAVTHAT RGEADRLAGCSRCALTPCQEAHRVTTKPRGDAGVEQVQTSDCSLCEGKLVGPSKPRLH RTLTLLRQEHGLNYLRRLQREWESLEAVQVPTPYLRFKYARHLEVRSM |
| SEQ ID NO: 94 | TDSQSESVPEVVYALTGGEVPGRVPPDGGSAEGARNAPTGLRKQRGKIKISAKPSKPGS PASSLARTLVNEAANVDGVQSSGCATCRMRANGSAPRALPIGCVACASSIGRAPQEETV CALPTTQGPDVRLLEGGHALRKYDIQRALEYWGVDLIGRNLDRQAGRGMEPAEGATA TMKRVSMDELAVLDFGKSYYASEQHLFAARQRRVRQHAKALKIRAKHANRSGSVKRA LDRSRKQVTALAREFFKPSDVVRGDSDALAHVVGRNLGVSRHPAREIPQTFTLPLCAY WEDVDRVISCSSLLAGEPFARDQEIRIEGVSSALGSLRLYRGAIEWHKPTSLYIRCSDTRR |

TABLE 2-continued

Cas14 Sequences

| SEQ ID NO | Sequence |
|---|---|
| | KFRPRGGLKKRWRQWAKDLDRLVEQRACCIVRSLQADVELLQTMERAQRFYDVHDC<br>AATHVGPVAVRCSPCAGKQFDWDRYRLLAALRQEHALNYLRRLQREWESLEAQQVK<br>MPYLRFKYARKLEVSGPLIGLEVRREPSMGTAIAEM |
| SEQ ID NO: 95 | AGTAGRRHGSLGARRSINIAGVTDRHGRWGCESCVYTRDQAGNRARCAPCDQSTYAP<br>DVQEVTIGQRQAKYTIFLTLQSFSWTNTMRNNKRAAAGRSKRTTGKRIGQLAEIKITGV<br>GLAHAHNVIQRSLQHNITKMWRAEKGKSKRVARLKKAKQLTKRRAYFRRRMSRQSRG<br>NGFFRTGKGGIHAVAPVKIGLDVGMIASGSSEPADEQTVTLDAIWKGRKKKIRLIGAKG<br>ELAVAACRFREQQTKGDKCIPLILQDGEVRWNQNNWQCHPKKLVPLCGLEVSRKFVSQ<br>ADRLAQNKVASPLAARFDKTSVKGTLVESDFAAVLVNVTSIYQQCHAMLLRSQEPTPS<br>LRVQRTITSM |
| SEQ ID NO: 96 | GVRFSPAQSQVFFRTVIPQSVEARFAINMAAIHDAAGAFGCSVCRFEDRTPRNAKAVHG<br>CSPCTRSTNRPDVFVLPVGAIKAKYDVFMRLLGFNWTHLNRRQAKRVTVRDRIGQLDE<br>LAISMLTGKAKAVLKKSICHNVDKSFKAMRGSLKKLHRKASKTGKSQLRAKLSDLRER<br>TNTTQEGSHVEGDSDVALNKIGLDVGLVGKPDYPSEESVEVVVCLYFVGKVLILDAQG<br>RIRDMRAKQYDGFKIPIIQRGQLTVLSVKDLGKWSLVRQDYVLAGDLRFEPKISKDRKY<br>AECVKRIALITLQASLGFKERIPYYVTKQVEIKNASHIAFVTEAIQNCAENFREMTEYLM<br>KYQEKSPDLKVLLTQLM |
| SEQ ID NO: 97 | RAVVGKVFLEQARRALNLATNFGTNHRTGCNGCYVTPGKLSIPQDGEKNAAGCTSCL<br>MKATASYVSYPKPLGEKVAKYSTLDALKGFPWYSLRLNLRPNYRGKPINGVQEVAPVS<br>KFRLAEEVIQAVQRYHFTELEQSFPGGRRRLRELRAFYTKEYRRAPEQRQHVVNGDRNI<br>VVVVTVLHELGFSVGMFNEVELLPKTPIECAVNVFIRGNRVLLEVRKPQFDKERLLVESL<br>WKKDSRRHTAKWTPPNNEGRIFTAEGWKDFQLPLLLGSTSRSLRAIEKEGFVQLAPGRD<br>PDYNNTIDEQHSGRPPFLPLYLYLQGTISQEYCVFAGTWVIPFQDGISPYSTKDTFQPDLK<br>RKAYSLLLDAVKHRLGNKVASGLQYGRFPAIEELKRLVRMHGATRKIPRGEKDLLKKG<br>DPDTPEWWLLEQYPEFWRLCDAAAKRVSQNVGLLLSLKKQPLWQRRWLESRTRNEPL<br>DNLPLSMALTLHLTNEEAL |
| SEQ ID NO: 98 | AAVYSKFYIENHFKMGIPETLSRIRGPSIIQGFSVNENYINIAGVGDRDFIFGCKKCKYTR<br>GKPSSKKINKCHPCKRSTYPEPVIDVRGSISEFKYKIYNKLKQEPNQSIKQNTKGRMNPS<br>DHTSSNDGIIINGIDNRIAYNVIFSSYKHLMEKQINLLRDTTKRKARQIKKYNNSGKKKH<br>SLRSQTKGNLKNRYHMLGMFKKGSLTITNEGDFITAVRKVGLDISLYKNESLNKQEVET<br>ELCLNIKWGRTKSYTVSGYIPLPINIDWKLYLFEKETGLTLRLFGNKYKIQSKKFLIAQLF<br>KPKRPPCADPVVKKAQKWSALNAHVQQMAGLFSDSHLLKRELKNRMHKQLDFKSLW<br>VGTEDYIKWFEELSRSYVEGAEKSLEFFRQDYFCFNYTKQTTM |
| SEQ ID NO: 99 | PQQQRDLMLMAANYDQDYGNGCGPCTVVASAAYRPDPQAQHGCKRHLRTLGASAVT<br>HVGLGDRTATITALHRLRGPAALAARARAAQAASAPMTPDTDAPDDRRRLEAIDADDV<br>VLVGAHRALWSAVRRWADDRRAALRRRLHSEREWLLKDQIRWAELYTLIEASGTPPQ<br>GRWRNTLGALRGQSRWRRVLAPTMRATCAETHAELWDALAELVPEMAKDRRGLLRP<br>PVEADALWRAPMIVEGWRGGHSVVVDAVAPPLDLPQPCAWTAVRLSGDPRQRWGLH<br>LAVPPLGQVQPPDPLKATLAVSMRHRGGVRVRTLQAMAVDADAPMQRHLQVPLTLQR<br>GGGLQWGIHSRGVRRREARSMASWEGPPIWTGLQLVNRWKGQGSALLAPDRPPDTPP<br>YAPDAAVAPAQPDTKRARRTLKEACTVCRCAPGHMRQLQVTLTGDGTWRRFRLAPQ<br>GAKRKAEVLKVATQHDERIANYTAWYLKRPEHAAGCDTCDGDSRLDGACRGCRPLLV<br>GDQCFRRYLDKIEADRDDGLAQIKPKAQEAVAAMAAKRDARAQKVAARAAKLSEAT<br>GQRTAATRDASHEARAQKELEAVATEGTTVRHDAAAVSAFGSWVARKGDEYRHQVG<br>VLANRLEHGLRLQELMAPDSVVADQQRASGHARVGYRYVLTAM |
| SEQ ID NO: 100 | AVAHPVGRGNAGSPGARGPEELPRQLVNRASNVTRPATYGCAPCRHVRLSIPKPVLTG<br>CRACEQTTHPAPKRAVRGGADAAKYDLAAFFAGWAADLEGRNRRRQVHAPLDPQPDP<br>NHEPAVTLQKIDLAEVSIEEFQRVLARSVKHRHDGRASREREKARAYAQVAKKRRNSH<br>AHGARTRRAVRRQTRAVRRAHRMGANSGEILVASGAEDPVPEAIDHAAQLRRRIRACA<br>RDLEGLRHLSRRYLKTLEKPCRRPRAPDLGRARCHALVESLQAAERELEELRRCDSPDT<br>SRRVIVSKPIAGMPIRRHELIRLEGLGTLRLDGNHYTGAGVTKGRGLSEGTEPDFREKSP<br>STLGFTLSDYRHESRWRPYGAKQGKTARQFFAAMSRELRALVEHQVLAPMGPPLLEAH<br>ERRFETLLKGQDNKSIHAGGGGRYVWRGPPDSKKRPAADGDWFRFGRGHADHRGWA<br>NKRHELAANYLQSAFRLWSTLAEAQEPTPYARYKYTRVTM |
| SEQ ID NO: 101 | WDFLTLQVYERHTSPEVCVAGNSTKCASGTRKSDHTHGVGVKLGAQEINVSANDDRD<br>HEVGCNICVISRVSLDIKGWRYGCESCVQSTPEWRSIVRFDRNHKEAKGECLSRPFEYWG<br>AQSIARSLKRNKLMGGVNLDELAIVQNENVVKTSLKHLFDKRKDRIQANLKAVKVRM<br>RERRKSGRQRKALRRQCRKLKRYLRSYDPSDIKEGNSCSAFTKLGLDIGISPNKPPKIEP<br>KVEVVFSLFYQGACDKIVTVSSPESPLPRSWKIKIDGIRALYVKSTKVKFGGRTFRAGQR<br>NNRRKVRPPNVKKGKRKGSRSQFFNKFAVGLDAVSQQLPIASVQGLWGRAETKKAQTI<br>CLKQLESNKPLKESQRCLFLADNWVVRVCGFLRALSQRQGPTPYIRYRYRCNM |
| SEQ ID NO: 102 | ARNVGQRNASRQSKRESAKARSRRVTGGHASVTQGVALINAAANADRDHTTGCEPCT<br>WERVNLPLQEVIHGCDSCTKSSPFWRDIKVVNKGYREAKEEIMRIASGISADHLSRALS<br>HNKVMGRLNLDEVCILDFRTVLDTSLKHLTDSRSNGIKEHIRAVHRKIRMRRKSGKTAR<br>ALRRKQYFALRRQWKAGHKPNSIREGNSLTALRAVGFDVGVSEGTEPMPAPQTEVVLSV<br>FYKGSATRILRISSPHPIAKRSWKVKIAGIKALKLIRREHDFSFGRETYNASQRAEKRKFS |

TABLE 2-continued

Cas14 Sequences

| SEQ ID NO | Sequence |
|---|---|
| | PHAARKDFFNSFAVQLDRLAQQLCVSSVENLWVTEPQQKLLTLAKDTAPYGIREGARF ADTRARLAWNWVFRVCGFTRALHQEQEPTPYCRFTWRSKM |

In some embodiments, the Type VI CRISPR/Cas enzyme is a programmable Cas13 nuclease. The general architecture of a Cas13 protein includes an N-terminal domain and two HEPN (higher eukaryotes and prokaryotes nucleotide-binding) domains separated by two helical domains (Liu et al., Cell 2017 Jan. 12; 168(1-2):121-134.e12). The HEPN domains each comprise aR—$X_4$—H motif. Shared features across Cas13 proteins include that upon binding of the crRNA of the guide nucleic acid to a target nucleic acid, the protein undergoes a conformational change to bring together the HEPN domains and form a catalytically active RNase. (Tambe et al., Cell Rep. 2018 Jul. 24; 24(4): 1025-1036.). Thus, two activatable HEPN domains are characteristic of a programmable Cas13 nuclease of the present disclosure. In some embodiments, a programmable nuclease (e.g., a Cas13 programmable nuclease) comprises at least two HEPN domains. However, programmable Cas13 nucleases also consistent with the present disclosure include Cas13 nucleases comprising mutations in the HEPN domain that enhance the Cas13 proteins cleavage efficiency or mutations that catalytically inactivate the HEPN domains. Programmable Cas13 nucleases consistent with the present disclosure also Cas13 nuclease comprising catalytic.

A programmable Cas13 nuclease can be a Cas13a protein (also referred to as "c2c2"), a Cas13b protein, a Cas13c protein, a Cas13d protein, or a Cas13e protein. Example C2c2 proteins are set forth as SEQ ID NO: 103-SEQ ID NO: 110. Example Cas13b proteins are set forth in SEQ ID NO: 128-SEQ ID NO: 132. Example Cas13c proteins are set forth in SEQ ID NO: 133-SEQ ID NO: 137. In some cases, a subject C2c2 protein includes an amino acid sequence having 80% or more (e.g., 85% or more, 90% or more, 95% or more, 98% or more, 99% or more, 99.5% or more, or 100%) amino acid sequence identity with the amino acid sequence set forth in any one of SEQ ID NO: 103-SEQ ID NO: 110. In some embodiments, a programmable nuclease has at least 60%, at least 70%, at least 80%, at least 85%, at least 90%, at least 92%, at least 95%, at least 97%, at least 99%, or 100% sequence identity to any one of SEQ ID NO: 103-SEQ ID NO: 137. In some embodiments, the programmable nuclease has at least 60%, at least 70%, at least 80%, at least 85%, at least 90%, at least 92%, at least 95%, at least 97%, at least 99%, or 100% sequence identity to SEQ ID NO: 104. In some cases, a suitable C2c2 polypeptide comprises an amino acid sequence having at least 80%, at least 85%, at least 90%, at least 95%, at least 98%, at least 99%, or 100%, amino acid sequence identity to the *Listeria seeligeri* C2c2 amino acid sequence set forth in SEQ ID NO: 103. In some cases, a suitable C2c2 polypeptide comprises an amino acid sequence having at least 80%, at least 85%, at least 90%, at least 95%, at least 98%, at least 99%, or 100%, amino acid sequence identity to the *Leptotrichia buccalis* C2c2 amino acid sequence set forth in SEQ ID NO: 104. In some cases, a suitable C2c2 polypeptide comprises an amino acid sequence having at least 80%, at least 85%, at least 90%, at least 95%, at least 98%, at least 99%, or 100%, amino acid sequence identity to the *Rhodobacter capsulatus* C2c2 amino acid sequence set forth in SEQ ID NO: 106. In some cases, a suitable C2c2 polypeptide comprises an amino acid sequence having at least 80%, at least 85%, at least 90%, at least 95%, at least 98%, at least 99%, or 100%, amino acid sequence identity to the *Carnobacterium gallinarum* C2c2 amino acid sequence set forth in SEQ ID NO: 107. In some cases, a suitable C2c2 polypeptide comprises an amino acid sequence having at least 80%, at least 85%, at least 90%, at least 95%, at least 98%, at least 99%, or 100%, amino acid sequence identity to the *Herbinix hemicellulosilytica* C2c2 amino acid sequence set forth in SEQ ID NO: 108. In some cases, the C2c2 protein includes an amino acid sequence having 80% or more amino acid sequence identity with the *Leptotrichia buccalis* (Lbu) C2c2 amino acid sequence set forth in SEQ ID NO: 104. In some cases, the C2c2 protein is a *Leptotrichia buccalis* (Lbu) C2c2 protein (e.g., see SEQ ID NO: 104). In some cases, the C2c2 protein includes the amino acid sequence set forth in any one of SEQ ID NOs: 103-104 and SEQ ID NOs: 106-110. In some cases, a C2c2 protein used in a method of the present disclosure is not a *Leptotrichia shahii* (Lsh) C2c2 protein. In some cases, a C2c2 protein used in a method of the present disclosure is not a C2c2 polypeptide having at least 80%, at least 85%, at least 90%, at least 95%, at least 98%, at least 99%, or 100%, amino acid sequence identity to the Lsh C2c2 polypeptide set forth in SEQ ID NO: 105.

TABLE 3

Cas13 Sequences

| SEQ ID NO | Description | Sequence |
|---|---|---|
| SEQ ID NO: 103 | *Listeria seeligeri* C2c2 amino acid sequence | MWISIKTLIHHLGVLFFCDYMYNRREKKIIEVKTMRITKVEVDRKKV LISRDKNGGKLVYENEMQDNTEQIMHHKKSSFYKSVVNKTICRPEQ KQMKKLVHGLLQENSQEKIKVSDVTKLNISNFLNHRFKKSLYYFPE NSPDKSEEYRIEINLSQLLEDSLKKQQGTFICWESFSKDMELYINWA ENYISSKTKLIKKSIRNNRIQSTESRSGQLMDRYMKDILNKNKPFDIQ SVSEKYQLEKLTSALKATFKEAKKNDKEINYKLKSTLQNHERQIIEE LKENSELNQFNIEIRKHLETYFPIKKTNRKVGDIRNLEIGEIQKIVNHR |

TABLE 3-continued

Cas13 Sequences

| SEQ ID NO | Description | Sequence |
|---|---|---|
| | | LKNKIVQRILQEGKLASYEIESTVNSNSLQKIKIEEAFALKFINACLFA<br>SNNLRNMVYPVCKKDILMIGEFKNSFKEIKHKKFIRQWSQFFSQEIT<br>VDDIELASWGLRGAIAPIRNEIIHLKKHSWKKFFNNPTFKVKKSKIIN<br>GKTKDVTSEFLYKETLFKDYFYSELDSVPELIINKMESSKILDYYSSD<br>QLNQVFTIPNFELSLLTSAVPFAPSFKRVYLKGFDYQNQDEAQPDYN<br>LKLNIYNEKAFNSEAFQAQYSLFKMVYYQVFLPQFTTNNDLFKSSV<br>DFILTLNKERKGYAKAFQDIRKMNKDEKPSEYMSYIQSQLMLYQKK<br>QEEKEKINHFEKFINQVFIKGFNSFIEKNRLTYICHPTKNTVPENDNIE<br>IPFHTDMDDSNIAFWLMCKLLDAKQLSELRNEMIKFSCSLQSTEEIST<br>FTKAREVIGLALLNGEKGCNDWKELFDDKEAWKKNMSLYVSEELL<br>QSLPYTQEDGQTPVINRSIDLVKKYGTETILEKLFSSSDDYKVSAKDI<br>AKLHEYDVTEKIAQQESLHKQWIEKPGLARDSAWTKKYQNVINDIS<br>NYQWAKTKVELTQVRHLHQLTIDLLSRLAGYMSIADRDFQFSSNYI<br>LERENSEYRVTSWILLSENKNKNKYNDYELYNLKNASIKVSSKNDP<br>QLKVDLKQLRLTLEYLELFDNRLKEKRNNISHFNYLNGQLGNSILEL<br>FDDARDVLSYDRKLKNAVSKSLKEILSSHGMEVTFKPLYQTNHHLK<br>IDKLQPKKIHHLGEKSTVSSNQVSNEYCQLVRTLLTMK |
| SEQ ID NO: 104 | Leptotrichia buccalis (Lbu) C2c2 amino acid sequence | MKVTKVGGISHKKYTSEGRLVKSESEENRTDERLSALLNMRLDMYI<br>KNPSSTETKENQKRIGKLKKFFSNKMVYLKDNTLSLKNGKKENIDR<br>EYSETDILESDVRDKKNFAVLKKIYLNENVNSEELEVFRNDIKKKLN<br>KINSLKYSFEKNKANYQKINENNIEKVEGKSKRNIIYDYYRESAKRD<br>AYVSNVKEAFDKLYKEEDIAKLVLEIENLTKLEKYKIREFYHEIIGRK<br>NDKENFAKIIYEEIQNVNNMKELIEKVPDMSELKKSQVFYKYYLDK<br>EELNDKNIKYAFCHFVEIEMSQLLKNYVYKRLSNISNDKIKRIFEYQ<br>NLKKLIENKLLNKLDTYVRNCGKYNYYLQDGEIATSDFIARNRQNE<br>AFLRNIIGVSSVAYFSLRNILETENENDITGRMRGKTVKNNKGEEKY<br>VSGEVDKIYNENKKNEVKENLKMFYSYDFNMDNKNEIEDFFANIDE<br>AISSIRHGIVHFNLELEGKDIFAFKNIAPSEISKKMFQNEINEKKLKLK<br>IFRQLNSANVFRYLEKYKILNYLKRTRFEFVNKNIPFVPSFTKLYSRI<br>DDLKNSLGIYWKTPKTNDDNKTKEIIDAQIYLLKNIYYGEFLNYFMS<br>NNGNFFEISKEIIELNKNDKRNLKTGFYKLQKFEDIQEKIPKEYLANI<br>QSLYMINAGNQDEEEKDTYIDFIQKIFLKGFMTYLANNGRLSLIYIGS<br>DEETNTSLAEKKQEFDKFLKKYEQNNNIKIPYEINEFLREIKLGNILK<br>YTERLNMFYLILKLLNHKELTNLKGSLEKYQSANKEEAFSDQLELIN<br>LLNLDNNRVTEDFELEADEIGKFLDFNGNKVDKNKELKKFDTNKIY<br>FDGENIIKHRAFYNIKKYGMLNLLEKIADKAGYKISIEELKKYSNKK<br>NEIEKNHKMQENLHRKYARPRKDEKFTDEDYESYKQAIENIEEYTH<br>LKNKVEFNELNLLQGLLLRILHRLVGYTSIWERDLRFRLKGEFPENQ<br>YIEEIFNFENKKNVKYKGGQIVEKYIKFYKELHQNDEVKINKYSSAN<br>IKVLKQEKKDLYIRNYIAHFNYIPHAEISLLEVLENLRKLLSYDRKLK<br>NAVMKSVVDILKEYGFVATFKIGADKKIGIQTLESEKIVHLKNLKKK<br>KLMTDRNSEELCKLVKIMFEYKMEEKKSEN |
| SEQ ID NO: 105 | Leptotrichia shahii (Lsh) C2c2 protein | MGNLFGHKRWYEVRDKKDFKIKRKVKVKRNYDGNKYILNINENN<br>NKEKIDNNKFIRKYINYKKNDNILKEFTRKFHAGNILFKLKGKEGIIR<br>IENNDDFLETEEVVLYIEAYGKSEKLKALGITKKKIIDEAIRQGITKD<br>DKKIEIKRQENEEEIEIDIRDEYTNKTLNDCSIILRIIENDELETKSIYE<br>IFKNINMSLYKIIEKIIENETEKVFENRYYEEHLREKLLKDDKIDVILT<br>NFMEIREKIKSNLEILGFVKFYLNVGGDKKKSKNKKMLVEKILNINV<br>DLTVEDIADFVIKELEFWNITKRIEKVKKVNNEFLEKRRNRTYIKSY<br>VLLDKHEKFKIERENKKDKIVKFFVENIKNNSIKEKIEKILAEFKIDEL<br>IKKLEKELKKGNCDTEIFGIFKKHYKVNFDSKKFSKKSDEEKELYKII<br>YRYLKGRIEKILVNEQKVRLKKMEKIEIEKILNESILSEKILKRVKQY<br>TLEHIMYLGKLRHNDIDMTTVNTDDFSRLHAKEELDLELITFFASTN<br>MELNKIFSRENINNDENIDFFGGDREKNYVLDKKILNSKIKIIRDLDFI<br>DNKNNITNNFIRKFTKIGTNERNRILHAISKERDLQGTQDDYNKVINI<br>IQNLKISDEEVSKALNLDVVFKDKKNIITKINDIKISEENNNDIKYLPS<br>FSKVLPEILNLYRNNPKNEPFDTIETEKIVLNALIYVNKELYKKLILE<br>DDLEENESKNIFLQELKKTLGNIDEIDENIIENYYKNAQISASKGNNK<br>AIKKYQKKVIECYIGYLRKNYEELFDFSDFKMNIQEIKKQIKDINDN<br>KTYERITVKTSDKTIVINDDFEYIISIFALLNSNAVINKIRNRFFATSV<br>WLNTSEYQNIIIDILDEIMQLNTLRNECITENWNLNLEEFIQKMKEIEK<br>DFDDFKIQTKKEIFNNYYEDIKNNILTEFKDDINGCDVLEKKLEKIVI<br>FDDETKFEIDKKSNILQDEQRKLSNINKKDLKKKVDQYIKDKDQEIK<br>SKILCRIIFNSDFLKKYKKEIDNLIEDMESENENKFQEIYYPKERKNEL<br>YIYKKNLFLNIGNPNFDKIYGLISNDIKMADAKFLFNIDGKNIRKNKI<br>SEIDAILKNLNDKLNGYSKEYKEKYIKKLKENDDFFAKNIQNKNYK<br>SFEKDYNRVSEYKKIRDLVEFNYLNKIESYLIDINWKLAIQMARFER<br>DMHYIVNGLRELGIIKLSGYNTGISRAYPKRNGSDGFYTTTAYYKFF<br>DEESYKKFEKICYGFGIDLSENSEINKPENESIRNYISHFYIVRNPFAD<br>YSIAEQIDRVSNLLSYSTRYNNSTYASVFEVFKKDVNLDYDELKKKF<br>KLIGNNDILERLMKPKKVSVLELESYNSDYIKNLIIELLTKIENTNDT<br>L |

TABLE 3-continued

Cas13 Sequences

| SEQ ID NO | Description | Sequence |
|---|---|---|
| SEQ ID NO: 106 | Rhodobacter capsulatus C2c2 amino acid sequence | MQIGKVQGRTISEFGDPAGGLKRKISTDGKNRKELPAHLSSDPKALI GQWISGIDKIYRKPDSRKSDGKAIHSPTPSKMQFDARDDLGEAFWK LVSEAGLAQDSDYDQFKRRLHPYGDKFQPADSGAKLKFEADPPEPQ AFHGRWYGAMSKRGNDAKELAAALYEHLHVDEKRIDGQPKRNPK TDKFAPGLVVARALGIESSVLPRGMARLARNWGEEEIQTYFVVDVA ASVKEVAKAAVSAAQAFDPPRQVSGRSLSPKVGFALAEHLERVTGS KRCSFDPAAGPSVLALHDEVKKTYKRLCARGKNAARAFPADKTEL LALMRHTHENRVRNQMVRMGRVSEYRGQQAGDLAQSHYWTSAG QTEIKESEIFVRLWVGAFALAGRSMKAWIDPMGKIVNTEKNDRDLT AAVNIRQVISNKEMVAEAMARRGIYFGETPELDRLGAEGNEGFVFA LLRYLRGCRNQTFHLGARAGFLKEIRKELEKTRWGKAKEAEHVVL TDKTVAAIRAIIDNDAKALGARLLADLSGAFVAHYASKEHFSTLYSE IVKAVKDAPEVSSGLPRLKLLLKRADGVRGYVHGLRDTRKHAFAT KLPPPPAPRELDDPATKARYIALLRLYDGPFRAYASGITGTALAGPA ARAKEAATALAQSVNVTKAYSDVMEGRSSRLRPPNDGETLREYLS ALTGETATEFRVQIGYESDSENARKQAEFIENYRRDMLAFMFEDYIR AKGFDWILKIEPGATAMTRAPVLPEPIDTRGQYEHWQAALYLVMH FVPASDVSNLLHQLRKWEALQGKYELVQDGDATDQADARREALD LVKRFRDVLVLFLKTGEARFEGRAAPFDLKPFRALFANPATFDRLF MATPTTARPAEDDPEGDGASEPELRVARTLRGLRQIARYNHMAVLS DLFAKHKVRDEEVARLAEIEDETQEKSQIVAAQELRTDLHDKVMK CHPKTISPEERQSYAAAIKTIEEHRFLVGRVYLGDHLRLHRLMMDVI GRLIDYAGAYERDTGTFLINASKQLGAGADWAVTIAGAANTDART QTRKDLAHFNVLDRADGTPDLTALVNRAREMMAYDRKRKNAVPR SILDMLARLGLTLKWQMKDHLLQDATITQAAIKHLDKVRLTVGGP AAVTEARFSQDYLQMVAAVFNGSVQNPKPRRRDDGDAWHKPPKP ATAQSQPDQKPPNKAPSAGSRLPPPQVGEVYEGVVVKVIDTGSLGF LAVEGVAGNIGLHISRLRRIREDAHVGRRYRFRVEIYVPPKSNTSKL NAADLVRID |
| SEQ ID NO: 107 | Carnobacterium gallinarum C2c2 amino acid sequence | MRITKVKIKLDNKLYQVTMQKEEKYGTLKLNEESRKSTAEILRLKK ASFNKSFHSKTINSQKENKNATIKKNGDYISQIFEKLVGVDTNKNIR KPKMSLTDLKDLPKKDLALFIKRKFKNDDIVEIKNLDLISLFYNALQ KVPGEHFTDESWADFCQEMMPYREYKNKFIERKIILLANSIEQNKGF SINPETFSKRKRVLHQWAIEVQERGDFSILDEKLSKLAEIYNFKKMC KRVQDELNDLEKSMKKGKNPEKEKEAYKKQKNFKIKTIWKDYPYK THIGLIEKIKENEELNQFNIEIGKYFEHYFPIKKERCTEDEPYYLNSETI ATTVNYQLKNALISYLMQIGKYKQFGLENQVLDSKKLQEIGIYEGF QTKFMDACVFATSSLKNIIEPMRSGDILGKREFKEAIATSSFVNYHHF FPYFPPFELKGMKDRESELIPPFGEQTEAKQMQNIWALRGSVQQIRNEI FHSFDKNQKFNLPQLDKSNFEFDASENSTGKSQSYIETDYKFLFEAE KNQLEQFFIERIKSSGALEYYPLKSLEKLFAKKEMKFSLGSQVVAFA PSYKKLVKKGHSYQTATEGTANYLGLSYYNRYELKEESFQAQYYL LKLIYQYVFLPNFSQGNSPAFRETVKAILRINKDEARKKMKKNKKFL RKYAFEQVREMEFKETPDQYMSYLQSEMREEKVRKAEKNDKGFEK NITMNFEKLLMQIFVKGFDVFLTTFAGKELLLSSEEKVIKETEISLSK KINEREKTLKASIQVEHQLVATNSAISYWLFCKLLDSRHLNELRNEM IKFKQSRIKFNHTQHAELIQNLLPIVELTILSNDYDEKNDSQNVDVSA YFEDKSLYETAPYVQTDDRTRVSFRPILKLEKYHTKSLIEALLKDNP QFRVAATDIQEWMHKREEIGELVEKRKNLHTEWAEGQQTLGAEKR EEYRDYCKKIDRFNWKANKVTLTYLSQLHYLITDLLGRMVGFSALF ERDLVYFSRSFSELGGETYHISDYKNLSGVLRLNAEVKPIKIKNIKVI DNEENPYKGNEPEVKPFLDRLHAYLENVIGIKAVHGKIRNQTAHLS VLQLELSMIESMNNLRDLMAYDRKLKNAVTKSMIKILDKHGMILKL KIDENHKNFEIESLIPKEIIHLKDKAIKTNQVSEEYCQLVLALLTTNPG NQLN |
| SEQ ID NO: 108 | Herbinix hemicellulo- silytica C2c2 amino acid sequence | MKLTRRRISGNSVDQKITAAFYRDMSQGLLYYDSEDNDCTDKVIES MDFERSWRGRILKNGEDDKNPFYMFVKGLVGSNDKIVCEPIDVDSD PDNLDILINKNLTGFGRNLKAPDSNDTLENLIRKIQAGIPEEEVLPEL KKIKEMIQKDIVNRKEQLLKSIKNNRIPFSLEGSKLVPSTKKMKWLF KLIDVPNKTFNEKMLEKYWEIYDYDKLKANITNRLDKTDKKARSIS RAVSEELREYHKNLRTNYNRFVSGDRPAAGLDNGGSAKYNPDKEE FLLFLKEVEQYFKKYFPVKSKHSNKSKDKSLVDKYKNYCSYKVVK KEVNRSIINQLVAGLIQQGKLLYFYYNDTWQEDFLNSYGLSYIQV EEAFKKSVMTSLSWGINRLTSFFIDDSNTVKFDDITTKKAKEAIESNY FNKLRTCSRMQDHFKEKLAFFYPVYVKDKKRPDDDIENLIVLVKN AIESVSYLRNRTFHFKESSLLELLKELDDKNSGQNKIDYSVAAEFIKR DIENLYDVFREQIRSLGIAEYYKADMISDCFKTCGLEFALYSPKNSL MPAFKNVYKRGANLNKAYIRDKGPKETGDQGQNSYKALEEYRELT WYIEVKNNDQSYNAYKNLLQLIYYHAFLPEVRENEALITDFINRTKE WNRKETEERLNTKNNKKHKNFDENDDITVNTYRYESIPDYQGESLD DYLKVLQRKQMARAKEVNEKEEGNNNYIQFIRDVVVWAFGAYLE |

TABLE 3-continued

Cas13 Sequences

| SEQ ID NO | Description | Sequence |
|---|---|---|
| | | NKLKNYKNELQPPLSKENIGLNDTLKELFPEEKVKSPFNIKCRFSIST FIDNKGKSTDNTSAEAVKTDGKEDEKDKKNIKRKDLLCFYLFLRLL DENEICKLQHQFIKYRCSLKERRFPGNRTKLEKETELLAELEELMEL VRFTMPSIPEISAKAESGYDTMIKKYFKDFIEKKVFKNPKTSNLYYH SDSKTPVTRKYMALLMRSAPLHLYKDIFKGYYLITKKECLEYIKLSN IIKDYQNSLNELHEQLERIKLKSEKQNGKDSLYLDKKDFYKVKEYV ENLEQVARYKHLQHKINFESLYRIFRIHVDIAARMVGYTQDWERDM HFLFKALVYNGVLEERRFEAIFNNNDDNNDGRIVKKIQNNLNNKNR ELVSMLCWNKKLNKNEFGAIIWKRNPIAHLNHFTQTEQNSKSSLES LINSLRILLAYDRKRQNAVTKTINDLLLNDYHIRIKWEGRVDEGQIY FNIKEKEDIENEPIIHLKHLHKKDCYIYKNSYMFDKQKEWICNGIKEE VYDKSILKCIGNLFKFDYEDKNKSSANPKHT |
| SEQ ID NO: 109 | Paludibacter propionicigenes C2c2 amino acid sequence | MRVSKVKVKDGGKDKMVLVHRKTTGAQLVYSGQPVSNETSNILPE KKRQSFDLSTLNKTIIKFDTAKKQKLNVDQYKIVEKIFKYPKQELPK QIKAEEILPFLNHKFQEPVKYWKNGKEESFNLTLLIVEAVQAQDKR KLQPYYDWKTWYIQTKSDLLKKSIENNRIDLTENLSKRKKALLAWE TEFTASGSIDLTHYHKVYMTDVLCKMLQDVKPLTDDKGKINTNAY HRGLKKALQNHQPAIFGTREVPNEANRADNQLSIYHLEVVKYLEHY FPIKTSKRRNTADDIAHYLKAQTLKTTIEKQLVNAIRANIIQQGKTNH HELKADTTSNDLIRIKTNEAFVLNLTGTCAFAANNIRNMVDNEQTN DILGKGDFIKSLLKDNTNSQLYSFFFGEGLSTNKAEKETQLWGIRGA VQQIRNNVNHYKKDALKTVFNISNFENPTIIDPKQQTNYADTIYKA RFINELEKIPEAFAQQLKTGGAVSYYTIENLKSLLTTFQFSLCRSTIPF APGFKKVFNGGINYQNAKQDESFYELMLEQYLRKENFAEESYNAR YFMLKLIYNNLFLPGFTTDRKAFADSVGFVQMQNKKQAEKVNPRK KEAYAFEAVRPMTAADSIADYMAYVQSELMQEQNKKEEKVAEET RINFEKFVLQVFIKGFDSFLRAKEFDFVQMPQPQLTATASNQQKAD KLNQLEASITADCKLTPQYAKADDATHIAFYVFCKLLDAAHLSNLR NELIKFRESVNEFKFHHLLEIIEICLLSADVVPTDYRDLYSSEADCLA RLRPPIEQGADITNWSDLFVQSDKHSPVIHANIELSVKYGTTKLLEQI INKDTQFKTTEANFTAWNTAQKSIEQLIKQREDHHEQWVKAKNAD DKEKQERKREKSNFAQKFIEKHGDDYLDICDYINTYNWLDNKMHF VHLNRLHGLTIELLGRMAGFVALFDRDFQFFDEQQIADEFKLHGFV NLHSIDKKLNEVPTKKIKEIYDIRNKIIQINGNKINESVRANLIQFISSK RNYYNNAFLHVSNDEIKEKQMYDIRNHIAHFNYLTKDAADFSLIDLI NELRELLHYDRKLKNAVSKAFIDLFDKHGMILKLKLNADHKLKVES LEPKKIYHLGSSAKDKPEYQYCTNQVMMAYCNMCRSLLEMKK |
| SEQ ID NO: 110 | Leptotrichia wadei (Lwa) C2c2 amino acid sequence | MYMKITKIDGVSHYKKQDKGILKKKWKDLDERKQREKIEARYNKQ IESKIYKEFFRLKNKKRIEKEEDQNIKSLYFFIKELYLNEKNEEWELK NINLEILDDKERVIKGYKFKEDVYFFKEGYKEYYLRILFNNLIEKVQ NENREKVRKNKEFLDLKEIFKKYKNRKIDLLLKSINNNKINLEYKKE NVNEEIYGINPTNDREMTFYELLKEHEKKDEQKSILEEKLDNFIDTNF LENIEKIFNEETEINIIKGKVLNELREYIKEKEENNSDNKLKQIYNLEL KKYIENNFSYKKQKSKSKNGKNDYLYLNFLKKIMFIEEVDEKKEIN KEKFKNKINSNFKNLFVQHILDYGKLLYYKENDEYIKNTGQLETKD LEYIKTKETLIRKMAVLVSFAANSYYNLFGRVSGDILGTEVVKSSKT NVIKVGSHIFKEKMLNYFFDFEIFDANKIVEILESISYSIYNVRNGVG HFNKLILGKYKKKDINTNKRIEEDLNNNEEIKGYFIKKRGEIERKVK EKFLSNNLQYYYSKEKIENYFEVYEFEILKRKIPFAPNFKRIIKKGED LFNNKNNKKYEYFKNFDKNSAEEKKEFLKTRNFLLKELYYNNFYK EFLSKKEEFEKIVLEVKEEKKSRGNINNKKSGVSFQSIDDYDTKINIS DYIASIHKKEMERVEKYNEEKQKDTAKYIRDFVEEIFLTGFINYLEK DKRLHFLKEEFSILCNNNNNVVDFNININEEKIKEFLKENDSKTLNLY LFFNMIDSKRISEFRNELVKYKQFTKKRLDEEKEFLGIKIELYETLIEF VILTREKLDTKKSEEIDAWLVDKLYVKDSNEYKEYEEILKLFVDEKI LSSKEAPYYATDNKTPILLSNFEKTRKYGTQSFLSEIQSNYKYSKVE KENIEDYNKKEEIEQKKKSNIEKLQDLKVELHKKWEQNKITEKEIEK YNNTTRKINEYNYLKNKEELQNVYLLHEMLSDLLARNVAFFNKWE RDFKFPIVIAIKQFLRENDKEKVNEFLNPPDNSKGKKVYFSVSKYKNT VENIDGIHKNFMNLIFLNNKFMNRKIDKMNCAIWVYFRNYIAHFLH EISNDKNEVFKYKIKNRLYSKKGKMLGKNNKFEILENEFLENVKAM LEYSE |
| SEQ ID NO: 128 | Bergeyella zoohelcum Cas13b | MENKTSLGNNIYYNPFKPQDKSYFAGYFNAAMENTDSVFRELGKR LKGKEYTSENFFDAIFKENISLVEYERYVKLLSDYFPMARLLDKKEV PIKERKENFKKNFKGIIKAVRDLRNFYTHKEHGEVEITDEIFGVLDE MLKSTVLTVKKKKVKTDKTKEILKKSIEKQDILCQKKLEYLRDTA RKIEEKRRNQRERGEKELVAPFKYSDKRDDLIAAIYNDAFDVYIDK KKDSLKESSKAKYNTKSDPQQEEGDLKIPISKNGVVFLLSLFLTKQEI HAFKSKIAGFKATVIDEATVSEATVSHGKNSICFMATHEIFSHLAYK KLKRKVRTAEINYGEAENAEQLSVYAKETLMMQMLDELSKVPDVV YQNLSEDVQKTFIEDWNEYLKENNGDVGTMEEEQVIHPVIRKRYED |

TABLE 3-continued

Cas13 Sequences

| SEQ ID NO | Description | Sequence |
|---|---|---|
| | | KFNYFAIRFLDEFAQFPTLRFQVHLGNYLHDSRPKENLISDRRIKEKI TVFGRLSELEHKKALFIKNTETNEDREHYWEIFPNPNYDFPKENISV NDKDFPIAGSILDREKQPVAGKIGIKVKLLNQQYVSEVDKAVKAHQ LKQRKASKPSIQNIIEEIVPINESNPKEAIVFGGQPTAYLSMNDIHSILY EFFDKWEKKKEKLEKKGEKELRKEIGKELEKKIVGKIQAQIQQIIDK DTNAKILKPYQDGNSTAIDKEKLIKDLKQEQNILQKLKDEQTVREKE YNDFIAYQDKNREINKVRDRNHKQYLKDNLKRKYPEAPARKEVLY YREKGKVAVWLANDIKRFMPTDFKNEWKGEQHSLLQKSLAYYEQ CKEELKNLLPEKVFQHLPFKLGGYFQQKYLYQFYTCYLDKRLEYIS GLVQQAENFKSENKVFKKVENECFKFLKKQNYTHKELDARVQSIL GYPIFLERGFMDEKPTIIKGKTFKGNEALFADWFRYYKEYQNFQTFY DTENYPLVELEKKQADRKRKTKIYQQKKNDVFTLLMAKHIFKSVFK QDSIDQFSLEDLYQSREERLGNQERARQTGERNTNYIWNKTVDLKL CDGKITVENVKLKNVGDFIKYEYDQRVQAFLKYEENIEWQAFLIKE SKEEENYPYVVEREIEQYEKVRREELLKEVHLIEEYILEKVKDKEILK KGDNQNFKYYILNGLLKQLKNEDVESYKVFNLNTEPEDVNINQLKQ EATDLEQKAFVLTYIRNKFAHNQLPKKEFWDYCQEKYGKIEKEKTY AEYFAEVFKKEKEALIK |
| SEQ ID NO: 129 | Prevotella intermedia Cas13b | MEDDKKTTDSIRYELKDKHFWAAFLNLARHNVYITVNHINKILEEG EINRDGYETTLKNTWNEIKDINKKDRLSKLIIKHPPFLEAATYRLNPT DTTKQKEEKQAEAQSLESLRKSFFVFIYKLRDLRNHYSHYKHSKSLE RPKFEEGLLEKMYNIFNASIRLVKEDYQYNKDINPDEDFKHLDRTEE EFNYYFTKDNEGNITESGLLFFVSLFLEKKDAIWMQQKLRGFKDNR ENKKKMTNEVFCRSRMLLPKLRLQSTQTQDWILLDMLNELIRCPKS LYERLREEDREKFRVPIEIADEDYDAEQEPFKNTLVRHQDRFPYFAL RYFDYNEIFTNLRFQIDLGTYHFSIYKKQIGDYKESHHLTHKLYGFE RIQEFTKQNRPDEWRKFVKTFNSFETSKEPYIPETTPHYHLENQKIGI RFRNDNDKIWPSLKTNSEKNEKSKYKLDKSFQAEAFLSVHELLPMM FYYLLLKTENTDNDNEIETKKKENKNDKQEKHKIEEIIENKITEIYAL YDTFANGEIKSIDELEEYCKGKDIEIGHLPKQMIAILKDEHKVMATE AERKQEEMLVDVQKSLESLDNQINEEIENVERKNSSLKSGKIASWL VNDMMRFQPVQKDNEGKPLNNSKANSTEYQLLQRTLAFFGSEHER LAPYFKQTKLIESSNPHPFLKDTEWEKCNNILSFYRSYLEAKKNFLES LKPEDWEKNQYFLKLKEPKTKPKTLVQGWKNGFNLPRGIFTEPIRK WFMKHRENITVAELKRVGLVAKVIPLFFSEEYKDSVQPFYNYHFNV GNINKPDEKNFLNCEERRELLRKKKDEFKKMTDKEKEENPSYLEFK SWNKFERELRLVRNQDIVTWLLCMELFNKKKIKELNVEKIYLKNIN TNTTKKEKNTEEKNGEEKNIKEKNNILNRIMPMRLPIKVYGRENFSK NKKKKIRRNTFFTVYIEEKGTKLLKQGNFKALERDRRLGGLFSFVKT PSKAESKSNTISKLRVEYELGEYQKARIEIIKDMLALEKTLIDKYNSL DTDNFNKMLTDWLELKGEPDKASFQNDVDLLIAVRNAFSHNQYPM RNRIAFANINPFSLSSANTSEEKGLGIANQLKDTHKTIEKIIEIEKPIE TKE |
| SEQ ID NO: 130 | Prevotella buccae Cas13b | MQKQDKLFVDRKKNAIFAFPKYITIMENKEKPEPIYYELTDKHFWA AFLNLARHNVYTTINHINRRLEIAELKDDGYMMGIKGSWNEQAKK LDKKVRLRDLIMKHFPFLEAAAYEMTNSKSPNNKEQREKEQSEALS LNNLKNVLFIFLEKLQVLRNYYSHYKYSEESPKPIFETSLLKNMYKV FDANVRLVKRDYMHHENIDMQRDFTHLNRKKQVGRTKNIIDSPNF HYHFADKEGNMTIAGLLFFVSLFLDKKDAIWMQKKLKGFKDGRNL REQMTNEVFCRSRISLPKLKLENVQTKDWMQLDMLNELVRCPKSL YERLREKDRESFKVPFDIFSDDYNAEEEPFKNTLVRHQDRFPYFVLR YFDLNEIFEQLRFQIDLGTYHFSIYNKRIGDEDEVRHLTHHLYGFARI QDFAPQNQPEEWRKLVKDLDHFETSQEPYISKTAPHYHLENEKIGIK FCSAHNNLFPSLQTDKTCNGRSKFNLGTQFTAEAFLSVHELLPMMF YYLLLTKDYSRKESADKVEGIIRKEISNIYAIYDAFANNEINSIADLTR RLQNTNILQGHLPKQMISILKGRQKDMGKEAERKIGEMIDDTQRRL DLLCKQTNQKIRIGKRNAGLLKSGKIADWLVNDMMRFQPVQKDQN NIPINNSKANSTEYRMLQRALALFGSENFRLKAYFNQMNLVGNDNP HPFLAETQWEHQTNILSFYRNYLEARKKYLKGLKPQNWKQYQHFLI LKVQKTNRNTLVTGWKNSFNLPRGIFTQPIREWFEKHNNSKRIYDQI LSFDRVGFVAKAIPLYFAEEYKDNVQPFYDYPFNIGNRLKPKKRQFL DKKERVELWQKNKELFKNYPSEKKKTDLAYLDFLSWKKFERELRLI KNQDIVTWLMFKELFNMATVEGLKIGEIHLRDIDTNTANEESNNILN RIMPMKLPVKTYETDNKGNILKERPLATFYIEEETETKVLKQGNFKAL VKDRRLNGLFSFAETTDLNLEEHPISKLSVDLELIKYQTTRISIFEMTL GLEKKLIDKYSTLPTDSFRNMLERWLQCKANRPELKNYVNSLIAVR NAFSHNQYPMYDATLFAEVKKFTLFPSVDTKKIELNIAPQLLEIVGK AIKEIEKSENKN |

TABLE 3-continued

Cas13 Sequences

| SEQ ID NO | Description | Sequence |
|---|---|---|
| SEQ ID NO: 131 | Porphyromonas gingivalis Cas13b | MNTVPASENKGQSRTVEDDPQYFGLYLNLARENLIEVESHVRIKFG KKKLNEESLKQSLLCDHLLSVDRWTKVYGHSRRYLPFLHYFDPDSQ IEKDHDSKTGVDPDSAQRLIRELYSLLDFLRNDFSHNRLDGTTFEHL EVSPDISSFITGTYSLACGRAQSRFAVFFKPDDFVLAKNRKEQLISVA DGKECLTVSGFAFFICLFLDREQASGMLSRIRGFKRTDENWARAVH ETFCDLCIRHPHDRLESSNTKEALLLDMLNELNRCPRILYDMLPEEE RAQFLPALDENSMNNLSENSLDEESRLLWDGSSDWAEALTKRIRHQ DRFPYLMLRFIEEMDLLKGIRFRVDLGEIELDSYSKKVGRNGEYDRT ITDHALAFGKLSDFQNEEEVSRMISGEASYPVRFSLFAPRYAIYDNKI GYCHTSDPVYPKSKTGEKRALSNPQSMGFISVHDLRKLLLMELLCE GSFSRMQSDFLRKANRILDETAEGKLQFSALFPEMRHRFIPPQNPKS KDRREKAETTLEKYKQEIKGRKDKLNSQLLSAFDMDQRQLPSRLLD EWMNIRPASHSVKLRTYVKQLNEDCRLRLRKFRKDGDGKARAIPL VGEMATFLSQDIVRMIISEETKKLITSAYYNEMQRSLAQYAGEENRR QFRAIVAELRLLDPSSGHPFLSATMETAHRYTEGFYKCYLEKKREW LAKIFYRPEQDENTKRRISVFFVPDGEARKLLPLLIRRRMKEQNDLQ DWIRNKQAHPIDLPSHLFDSKVMELLKVKDGKKKWNEAFKDWWS TKYPDGMQPFYGLRRELNIHGKSVSYIPSDGKKFADCYTHLMEKTV RDKKRELRTAGKPVPPDLAADIKRSFHRAVNEREFMLRLVQEDDRL MLMAINKMMTDREEDILPGLKNIDSILDEENQFSLAVHAKVLEKEG EGGDNSLSLVPATIEIKSKRKDWSKYIRYRYDRRVPGLMSHFPEHK ATLDEVKTLLGEYDRCRIKIFDWAFALEGAIMSDRDLKPYLHESSSR EGKSGEHSTLVKMLVEKKGCLTPDESQYLILIRNKAAHNQFPCAAE MPLIYRDVSAKVGSIEGSSAKDLPEGSSLVDSLWKKYEMIIRKILPIL DPENRFFGKLLNNMSQPINDL |
| SEQ ID NO: 132 | Bacteroides pyogenes Cas13b | MESIKNSQKSTGKTLQKDPPYFGLYLNMALLNVRKVENHIRKWLG DVALLPEKSGFHSLLTTDNLSSAKWTRFYYKSRKFLPFLEMFDSDK KSYENRRETAECLDTIDRQKISSLLKEVYGKLQDIRNAFSHYHIDDQ SVKHTALIISSEMHRFIENAYSFALQKTRARFTGVFVETDFLQAEEK GDNKKFFAIGGNEGIKLKDNALIFLICLFLDREEAFKFLSRATGFKST KEKGFLAVRETFCALCCRQPHERLLSVNPREALLMDMLNELNRCPD ILFEMLDEKDQKSFLPLLGEEEQAHILENSLNDELCEAIDDPFEMIAS LSKRVRYKNRFPYLMLRYIEEKNLLPFIRFRIDLGCLELASYPKMG EENNYERSVTDHAMAFGRLTDFHNEDAVLQQITKGITDEVRFSLYA PRYAIYNNKIGFVRTSGSDKISFPTLKKKGGEGHCVAYTLQNTKSFG FISIYDLRKILLLSFLDKDKAKNIVSGLLEQCEKHWKDLSENLFDAIR TELQKEFPVPLIRYTLPRSKGGKLVSSKLADKQEKYESEFERRKEKL TEILSEKDFDLSQIPRRMIDEWLNVLPTSREKKLKGYVETLKLDCRE RLRVFEKREKGEHPLPPRIGEMATDLAKDIIRMVIDQGVKQRITSAY YSEIQRCLAQYAGDDNRRHLDSIIRELRLKDTKNGHPFLGKVLRPGL GHTEKLYQRYFEEKKEWLEATFYPAASPKRVPRFVNPPTGKQKELP LIIRNLMKERPEWRDWKQRKNSHPIDLPSQLFENEICRLLKDKIGKE PSGKLKWNEMFKLYWDKEFPNGMQRFYRCKRRVEVFDKVVEYEY SEEGGNYKKYYEALIDEVVRQKISSSKEKSKLQVEDLTLSVRRVFKR AINEKEYQLRLLCEDDRLLFMAVRDLYDWKEAQLDLDKIDNMLGE PVSVSQVIQLEGGQPDAVIKAECKLKDVSKLMRYCDGRVKGLMP YFANHEATQEQVEMELRHYEDHRRRVFNWVFALEKSVLKNEKLRR FYEESQGGCEHRRCIDALRKASLVSEEEYEFLVHIRNKSAHNQFPDL EIGKLPPNVTSGFCECIWSKYKAIICRIIPFIDPERRFFGKLLEQK |
| SEQ ID NO: 133 | Cas13c | MTEKKSIIFKNKSSVEIVKKDIFSQTPDNMIRNYKITLKISEKNPRVVE AEIEDLMNSTILKDGRRSARREKSMTERKLIEEKVAENYSLLANCPM EEVDSIKIYKIKRFLTYRSNMLLYFASINSFLCEGIKGKDNETEEIWH LKDNDVRKEKVKENFKNKLIQSTENYNSSLKNQIEEKEKLLRKESK KGAFYRTIIKKLQQERIKELSEKSLTEDCEKIIKLYSELRHPLMHYDY QYFENLFENKENSELTKNLNLDIFKSLPLVRKMKLNNKVNYLEDND TLFVQLQKTKKAKTLYQIYDALCEQKNGFNKFINDFFVSDGEENTVF KQIINEKFQSEMEFLEKRISESEKKNEKLKKKFDSMKAHPHNINSED TKEAYFWDIHSSSNYKTKYNERKNLVNEYTELLGSSKEKKLLREEIT QINRKLLLKLKQEMEEITKKNSLFRLEYKMKIAFGFLFCEFDGNISKF KDEFDASNQEKIIQYHKNGEKYLTYFLKEEEKEKFNLEKMQKIIQKT EEEDWLLPETKNNLFKFYLLTYLLLPYELKGDFLGFVKKHYYDIKN VDFMDENQNNIQVSQTVEKQEDYFYHKIRLFEKNTKKYEIVKYSIV PNEKLKQYFEDLGIDIKYLTGSVESGEKWLGENLGIDIKYLTVEQKS EVSEEKIKKFL |
| SEQ ID NO: 134 | Cas13c | MEKDKKGEKIDISQEMIEEDLRKILILFSRLRHSMVHYDYEFYQALY SGKDFVISDKNNLENRMISQLLDLNIFKELSKVKLIKDKAISNYLDK NTTIHVLGQDIKAIRLLDIYRDICGSKNGFNKFINTMITISGEEDREYK EKVIEHFNKKMENLSTYLEKLEKQDNAKRNNKRVYNLLKQKLIEQ QKLKEWFGGPYVYDIHSSKRYKELYIERKKLVDRHSKLFEEGLDEK NKKELTKINDELSKLNSEMKEMTKLNSKYRLQYKLQLAFGFILEEF DLNIDTFINNFDKDKDLIISNFMKKRDIYLNRVLDRGDNRLKNIIKEY |

TABLE 3-continued

Cas13 Sequences

| SEQ ID NO | Description | Sequence |
|---|---|---|
| | | KFRDTEDIFCNDRDNNLVKLYILMYILLPVEIRGDFLGFVKKNYYD MKHVDFIDKKDKEDKDTFFHDLRLFEKNIRKLEITDYSLSSGFLSKE HKVDIEKKINDFINRNGAMKLPEDITIEEFNKSLILPIMKNYQINFKLL NDIEISALFKIAKDRSITFKQAIDEIKNEDIKKNSKKNDKNNHKDKNI NFTQLMKRALHEKIPYKAGMYQIRNNISHIDMEQLYIDPLNSYMNS NKNNITISEQIEKIIDVCVTGGVTGKELNNNIINDYYMKKEKLVFNL KLRKQNDIVSIESQEKNKREEFVFKKYGLDYKDGEINIIEVIQKVNSL QEELRNIKETSKEKLKNKETLFRDISLINGTIRKNINFKIKEMVLDIVR MDEIRHINIHIYYKGENYTRSNIIKFKYAIDGENKKYYLKQHEINDIN LELKDKFVTLICNMDKHPNKNKQTINLESNYIQNVKFIIP |
| SEQ ID NO: 135 | Cas13c | MENKGNNKKIDFDENYNILVAQIKEYFTKEIENYNNRIDNIIDKKEL LKYSEKKEESEKNKKLEELNKLKSQKLKILTDEEIKADVIKIIKIFSDL RHSLMHYEYKYFENLFENKKNEELAELLNLNLFKNLTLLRQMKIEN KTNYLEGREEFNIIGKNIKAKEVLGHYNLLAEQKNGFNNFINSFFVQ DGTENLEFKKLIDEHFVNAKKRLERNIKKSKKLEKELEKMEQHYQR LNCAYVWDIHTSTTYKKLYNKRKSLIEEYNKQINEIKDKEVITAINV ELLRIKKEMEEITKSNSLFRLKYKMQIAYAFLEIEFGGNIAKFKDEFD CSKMEEVQKYLKKGVKYLKYYKDKEAQKNYEFPFEEIFENKDTHN EEWLENTSENNLFKFYILTYLLLPMEFKGDFLGVVKKHYYDIKNVD FTDESEKELSQVLDKMIGDSFFHKIRLFEKNTKRYEIIKYSILTSDEI KRYFRLLELDVPYFEYEKGTDEIGIFNKNIILTIFKYYQIIFRLYNDLEI HGLFNISSDLDKILRDLKSYGNKNINFREFLYVIKQNNNSSTEEEYRK IWENLEAKYLRLHLLTPEKEEIKTKTKEELEKLNEISNLRNGICHLNY KEIIEEILKTEISEKNKEATLNEKIRKVINFIKENELDKVELGFNFINDF FMKKEQFMFGQIKQVKEGNSDSITTERERKEKNNKKLKETYELNCD NLSEFYETSNNLRERANSSSLLEDSAFLKKIGLYKVKNNKVNSKVK DEEKRIENIKRKLLKDSSDIMGMYKAEVVKKLKEKLILIFKHDEEKR IYVTVYDTSKAVPENISKEILVKRNNSKEEYFFEDNNKKYVTEYYTL EITETNELKVIPAKKLEGKEFKTEKNKENKLMLNNHYCFNVKIIY |
| SEQ ID NO: 136 | Cas13c | MEEIKHKKNKSSIIRVIVSNYDMTGIKEIKVLYQKQGGVDTFNLKTII NLESGNLEIISCKPKEREKYRYEFNCKTEINTISITKKDKVLKKEIRKY SLELYFKNEKKDTVVAKVTDLLKAPDKIEGERNHLRKLSSSTERKL LSKTLCKNYSEISKTPIEEIDSIKIYKIKRFLNYRSNFLIYFALINDFLC AGVKEDDINEVWLIQDKEHTAFLENRIEKITDYIFDKLSKDIENKKN QFEKRIKKYKTSLEELKTETLEKNKTFYIDSIKTKITNLENKITELSLY NSKESLKEDLIKIISIFTNLRHSLMHYDYKSFENLFENIENEELKNLLD LNLFKSIRMSDEFKTKNRTNYLDGTESFTIVKKHQNLKKLYTYYNN LCDKKNGFNTFINSFFVTDGIENTDFKNLIILHFEKEMEEYKKSIEYY KIKISNEKNKSKKEKLKEKIDLLQSELINMREHKNLLKQIYFFDIHNSI KYKELYSERKNLIEQYNLQINGVKDVTAINHINTKLLSLKNKMDKIT KQNSLYRLKYKLKIAYSFLMIEFDGDVSKFKNNFDPTNLEKRVEYL DKKEEYLNYTAPKNKFNFAKLEEELQKIQSTSEMGADYLNVSPENN LFKFYILTYIMLPVEFKGDFLGFVKNHYYNIKNVDFMDESLLDENEV DSNKLNEKIENLKDSSFFNKIRLFEKNIKKYEIVKYSVSTQENMKEY FKQLNLDIPYLDYKSTDEIGIFNKNMILPIFKYYQNVFKLCNDIEIHA LLALANKKQQNLEYAIYCCSKKNSLNYNELLKTFNRKTYQNLSFIR NKIAHLNYKELFSDLFNNELDLNTKVRCLIEFSQNNKFDQIDLGMNF INDYYMKKTRFIFNQRRLRDLNVPSKEKIIDGKRKQQNDSNNELLK KYGLSRTNIKDIFNKAWY |
| SEQ ID NO: 137 | Cas13c | MKVRYRKQAQLDTFIIKTEIVNNDIFIKSIIEKAREKYRYSFLFDGEE KYHFKNKSSVEIVKNDIFSQTPDNMIRNYKITLKISEKNPRVVEAEIE DLMNSTILKDGRRSARREKSMTERKLIEEKVAENYSLLANCPIEEVD SIKIYKIKRFLTYRSNMLLYFASINSFLCEGIKGKDNETEEIWHLKDN DVRKEKVKENFKNKLIQSTENYNSSLKNQIEEKEKLSSKEFKKGAFY RTIIKKLQQERIKELSEKSLTEDCEKIIKLYSELRHPLMHYDYQYFEN LFENKENSELTKNLNLDIFKSLPLVRKMKLNNKVNYLEDNDTLFVL QKTKKAKTLYQIYDALCEQKNGFNKFINDFFVSDGEENTVFKQIINE KFQSEMEFLEKRISESEKKNEKLKKKLDSMKAHFRNINSEDTKEAYF WDIHSSRNYKTKYNERKNLVNEYTKLLGSSKEKKLLREEITKINRQL LKLKQEMEEITKKNSLFRLEYKMKIAFGFLFCEFDGNISKFKDEFDA SNQEKIIQYHKNGEKYLTSFLKEEEKEKFNLEKMQKIIQKTEEEDWL LPETKNNLFKFYLLTYLLLPYELKGDFLGFVKKHYYDIKNVDFMDE NQNNIQVSQTVEKQEDYFYHKIRLFEKNTKKYEIVKYSIVPNEKLKQ YFEDLGIDIKYLTGSVESGEKWLGENLGIDIKYLTVEQKSEVSEEKN KKVSLKNNGMFNKTILLFVFKYYQIAFKLFNDIELYSLFFLREKSEKP FEVFLEELKDKMIGKQLNFGQLLYVVYEVLVKNKDLDKILSKKIDY RKDKSFSPEIAYLRNFLSHLNYSKFLDNFMKINTNKSDENKEVLIPSI KIQKMIQFIEKCNLQNQIDFDFNFVNDFYMREKMFFIQLKQIFPDIN STEKQKKSEKEEILRKRYHLINKKNEQIKDEHEAQSQLYEKILSLQKI FSCDKNNFYRRLKEEKLLFLEKQGKKKISMKEIKDKIASDISDLLGIL KKEITRDIKDKLTEKFRYCEEKLLNISFYNHQDKKKEEGIRVFLIRDK |

TABLE 3-continued

Cas13 Sequences

| SEQ ID NO | Description | Sequence |
|---|---|---|
| | | NSDNFKFESILDDGSNKIFISKNGKEITIQCCDKVLETLMIEKNTLKIS SNGKIISLIPHYSYSIDVKY |

The programmable nuclease can be Cas13. Sometimes the Cas13 can be Cas13a, Cas13b, Cas13c, Cas13d, or Cas13e. In some cases, the programmable nuclease can be Mad7 or Mad2. In some cases, the programmable nuclease can be Cas12. Sometimes the Cas12 can be Cas12a, Cas12b, Cas12c, Cas12d (also referred to as CasY), or Cas12e. In some cases, the Cas12 can be a Cas12 variant (e.g., SEQ ID NO: 11), which is a specific protein variant within the Cas12 protein family/classification. In some cases, the programmable nuclease can be Csm1, Cas9, C2c4, C2c8, C2c5, C2c10, C2c9, or CasZ. Sometimes, the Csm1 can also be also called smCms1, miCms1, obCms1, or suCms1. Sometimes Cas13a can also be also called C2c2. Sometimes CasZ can also be called Cas14a, Cas14b, Cas14c, Cas14d, Cas14e, Cas14f, Cas14g, or Cas14h. The programmable nuclease can be a CRISPR-Cas (clustered regularly interspaced short palindromic repeats—CRISPR associated) nucleoprotein complex with trans cleavage activity, which can be activated by binding of a guide nucleic acid with a target nucleic acid. The CRISPR-Cas nucleoprotein complex can comprise a Cas protein (also referred to as a Cas nuclease) complexed with a guide nucleic acid, which can also be referred to as CRISPR enzyme. A guide nucleic acid can be a CRISPR RNA (crRNA). Sometimes, a guide nucleic acid comprises a crRNA and a trans-activating crRNA (tracrRNA). The CRISPR/Cas system used to detect a modified target nucleic acids can comprise CRISPR RNAs (crRNAs), trans-activating crRNAs (tracrRNAs), Cas proteins, and nucleic acids of a reporter.

The programmable nucleases described herein are capable of being activated when complexed with the guide nucleic acid and the target nucleic acid (e.g., DNA). A programmable nuclease can be capable of being activated when complexed with a guide nucleic acid and the target deoxyribonucleotide. The programmable nuclease can be activated upon binding of the guide nucleic acid to its target nucleic acid and degrades non-specifically nucleic acid in its environment. The programmable nuclease may have trans cleavage activity once activated. In some embodiments, an activated DNA-activated programmable RNA nuclease non-specifically degrades RNA in its environment (e.g., exhibits sequence-independent cleavage of RNA, such as RNA reporters). A DNA-activated programmable RNA nuclease can be a Cas protein (also referred to, interchangeably, as a Cas nuclease). A crRNA and Cas protein can form a CRISPR/Cas enzyme. In some embodiments, the DNA-activated programmable RNA nuclease is a Type VI CRISPR enzyme. Sometimes, the programmable nuclease is a type V CRISPR-Cas system. The programmable nuclease can be a type VI CRISPR-Cas system. Sometimes the programmable nuclease is a type III CRISPR-Cas system. In some embodiments, the DNA-activated programmable RNA nuclease is Cas13. Sometimes the Cas13 is Cas13a, Cas13b, Cas13c, Cas13d, or Cas13e. In some cases, the DNA-activated programmable RNA nuclease is from at least one of *Leptotrichia shahii* (Lsh), *Listeria seeligeri* (Lse), *Leptotrichia buccalis* (Lbu), *Leptotrichia wadeu* (Lwa), *Rhodobacter capsulatus* (Rca), *Herbinix hemicellulosilytica* (Hhe), *Paludibacter propionicigenes* (Ppr), *Lachnospiraceae bacterium* (Lba), [*Eubacterium*] *rectale* (Ere), *Listeria newyorkensis* (Lny), *Clostridium aminophilum* (Cam), *Prevotella* sp. (Psm), *Capnocytophaga canimorsus* (Cca, *Lachnospiraceae bacterium* (Lba), *Bergeyella zoohelcum* (Bzo), *Prevotella intermedia* (Pin), *Prevotella buccae* (Pbu), *Alistipes* sp. (Asp), *Riemerella anatipestifer* (Ran), *Prevotella aurantiaca* (Pau), *Prevotella saccharolytica* (Psa), *Prevotella intermedia* (Pin2), *Capnocytophaga canimorsus* (Cca), *Porphyromonas gulae* (Pgu), *Prevotella* sp. (Psp), *Porphyromonas gingivalis* (Pig), *Prevotella intermedia* (Pin3), *Enterococcus italicus* (Ei), *Lactobacillus salivarius* (Ls), or *Thermus thermophilus* (Tt). Sometimes the DNA-activated programmable RNA nuclease is at least one of LbuCas13a, LwaCas13a, LbaCas13a, HheCas13a, PprCas13a, EreCas13a, CamCas13a, or LshCas13a.

In some embodiments, a programmable nuclease is capable of being activated by a target RNA to initiate trans cleavage of an RNA reporter and is capable of being activated by a target DNA to initiate trans cleavage of an RNA reporter, such as a Type VI CRISPR protein (e.g., Cas13). For example, Cas13a of the present disclosure can be activated by a target RNA to initiate trans cleavage activity of the Cas13a for the cleavage of an RNA reporter and can be activated by a target DNA to initiate trans cleavage activity of the Cas13a for trans cleavage of an RNA reporter.

The trans cleavage activity of the DNA-activated programmable RNA nuclease can be activated when the crRNA is complexed with the target deoxyribonucleic acid. The trans cleavage activity of the DNA-activated programmable RNA nuclease can be activated when the guide nucleic acid comprising a tracrRNA and crRNA are complexed with the target deoxyribonucleic acid. The target deoxyribonucleic acid can be a DNA or reverse transcribed RNA, or an amplicon thereof. Preferably, the target deoxyribonucleic acid is single-stranded DNA. Thus, a Cas13a nuclease of the present disclosure can be activated by a target DNA to initiate trans cleavage activity of the Cas13a nuclease that cleaves an RNA reporter. For example, Cas13a nucleases disclosed herein are activated by the binding of the guide nucleic acid to a target DNA that was reverse transcribed from an RNA to cleave nucleic acids of a reporter in a sequence-independent manner. For example, Cas13a nucleases disclosed herein are activated by the binding of the guide nucleic acid to a target DNA that was amplified from a DNA to trans-collaterally cleave reporter molecules. The reporters can be RNA reporters. In some embodiments, the Cas13a recognizes and detects ssDNA and, further, trans cleaves RNA reporters. Multiple Cas13a isolates can recognize, be activated by, and detect target DNA as described herein, including ssDNA. For example, trans-collateral cleavage of RNA reporters can be activated in LbuCas13a or LwaCas13a by target DNA. Therefore, a DNA-activated programmable RNA nuclease can be used to detect target DNA by assaying for cleaved RNA reporters.

In some embodiments, the programmable nuclease may be present in the cleavage reaction at a concentration of about 10 nM, about 20 nM, about 30 nM, about 40 nM, about 50 nM, about 60 nM, about 70 nM, about 80 nM, about 90 nM, about 100 nM, about 200 nM, about 300 nM, about 400 nM, about 500 nM, about 600 nM, about 700 nM, about 800 nM, about 900 nM, about 1 µM, about 10 µM, or about 100 µM. In some embodiments, the programmable nuclease may be present in the cleavage reaction at a concentration of from 10 nM to 20 nM, from 20 nM to 30 nM, from 30 nM to 40 nM, from 40 nM to 50 nM, from 50 nM to 60 nM, from 60 nM to 70 nM, from 70 nM to 80 nM, from 80 nM to 90 nM, from 90 nM to 100 nM, from 100 nM to 200 nM, from 200 nM to 300 nM, from 300 nM to 400 nM, from 400 nM to 500 nM, from 500 nM to 600 nM, from 600 nM to 700 nM, from 700 nM to 800 nM, from 800 nM to 900 nM, from 900 nM to 1 µM, from 1 µM to 10 µM, from 10 µM to 100 µM, from 10 nM to 100 nM, from 10 nM to 1 µM, from 10 nM to 10 µM, from 10 nM to 100 µM, from 100 nM to 1 µM, from 100 nM to 10 µM, from 100 nM to 100 µM, or from 1 µM to 100 µM. In some embodiments, the programmable nuclease may be present in the cleavage reaction at a concentration of from 20 nM to 50 µM, from 50 nM to 20 µM, or from 200 nM to 5 µM.

A DNA-activated programmable RNA nuclease can be used to detect DNA at multiple pH values. A DNA-activated programmable RNA nuclease can be used to detect DNA at multiple pH values compared to an RNA-activated programmable RNA nuclease, such as a Cas13a complexed with a guide RNA that detects a target ribonucleic acid. For example, a Cas13 protein that detects a target RNA may exhibit high cleavage activity at pH values from 7.9 to 8.2. A Cas13 protein that detects a target DNA can exhibit consistent cleavage across a wide range of pH conditions, such as from a pH of 6.8 to a pH of 8.2. In some embodiments, Cas13 ssDNA detection may exhibit high cleavage activity at pH values from 6 to 6.5, from 6.1 to 6.6, from 6.2 to 6.7, from 6.3 to 6.8, from 6.4 to 6.9, from 6.5 to 7, from 6.6 to 7.1, from 6.7 to 7.2, from 6.8 to 7.3, from 6.9 to 7.4, from 7 to 7.5, from 7.1 to 7.6, from 7.2 to 7.7, from 7.3 to 7.8, from 7.4 to 7.9, from 7.5 to 8, from 7.6 to 8.1, from 7.7 to 8.2, from 7.8 to 8.3, from 7.9 to 8.4, from 8 to 8.5, from 8.1 to 8.6, from 8.2 to 8.7, from 8.3 to 8.8, from 8.4 to 8.9, from 8.5 to 9, from 6 to 8, from 6.5 to 8, or from 7 to 8. Preferrably, Cas13 ssDNA detection may exhibit high cleavage activity at pH values from 7.0 to 8.0. More preferably, Cas13 ssDNA detection may exhibit high cleavage activity at pH 7.5.

In some embodiments, a programmable nuclease is capable of being activated by a target RNA to initiate trans cleavage of an RNA reporter and is capable of being activated by a target DNA to initiate trans cleavage of an RNA reporter, such as a Type VI CRISPR protein (e.g., Cas13). For example, Cas13a of the present disclosure can be activated by a target RNA to initiate trans cleavage activity of the Cas13a for the cleavage of an RNA reporter and can be activated by a target DNA to initiate trans cleavage activity of the Cas13a for trans cleavage of an RNA reporter. In some embodiments, target DNA binding preferences of a DNA-activated programmable RNA nuclease can be distinct from target RNA binding preferences of a RNA-activated programmable RNA nuclease. In some embodiments, target DNA binding preferences of a guide nucleic acid complexed with a DNA-activated programmable RNA nuclease can be distinct from target RNA binding preferences of a guide nucleic acid complexed with a RNA-activated programmable RNA nuclease. For example, guide RNA (gRNA) binding to a target DNA, and preferably a target ssDNA, may not necessarily correlate with the binding of the same gRNAs binding to a target RNA. For example, gRNAs can perform at a high level regardless of target nucleotide identity at a 3' position in a sequence of a target RNA. In some embodiments, gRNAs can perform at a high level in the absence of a G at a 3' position in a sequence of a target DNA. Furthermore, target DNA detected by a DNA-activated programmable RNA nuclease complexed with a guide nucleic acid as disclosed herein can be directly from organisms, or can be indirectly generated by nucleic acid amplification methods, such as PCR and LAMP of DNA or reverse transcription of RNA. Key steps for the sensitive detection of direct DNA by a DNA-activated programmable RNA nuclease, such as a Cas13a, can include: (1) production or isolation of DNA to concentrations above about 0.1 nM per reaction for in vitro diagnostics, (2) selection of a target DNA with the appropriate sequence features to enable DNA detection as these some of these features are distinct from those required for target RNA detection, and (3) buffer composition that enhances DNA detection. The detection of DNA by a DNA-activated programmable RNA nuclease can be connected to a variety of readouts including fluorescence, lateral flow, electrochemistry, or any other readouts described herein. Multiplexing of a DNA-activated programmable RNA nuclease with a DNA-activated programmable DNA nuclease with RNA and DNA FQ-reporter molecules (each with a different color fluorophore), respectively, can enable detection of ssDNA or a combination of ssDNA and dsDNA, respectively. Multiplexing of different DNA-activated programmable RNA nuclease that have distinct RNA reporter cleavage preferences can enable additional multiplexing, such a first DNA-activated programmable RNA nuclease that preferentially cleaves uracil in an RNA reporter and a second DNA-activated programmable RNA nuclease that preferentially cleaves adenines in an RNA reporter. Methods for the generation of ssDNA for a DNA-activated programmable RNA nuclease-based detection or diagnostics can include (1) asymmetric PCR, (2) asymmetric isothermal amplification, such as RPA, LAMP, SDA, etc. (3) NEAR for the production of short ssDNA molecules, and (4) conversion of RNA targets into ssDNA by a reverse transcriptase followed by RNase H digestion. Thus, a DNA-activated programmable RNA nuclease detection of target DNA is compatible with the various systems, kits, compositions, reagents, and methods disclosed herein. Cas13a DNA detection can be employed in a DETECTR assay disclosed herein to provide CRISPR diagnostics leveraging Type VI systems (e.g., Cas13) for the detection of a target DNA.

Some programmable nucleases can exhibit a high turnover rate. Turnover rate quantifies how many molecules of a detector nucleic acid each programmable nuclease is cleaving per minute. Programmable nucleases with a higher turnover rate are more efficient and transcollateral cleavage in the DETECTR assay methods disclosed herein.

Turnover rate is quantified as the max transcleaving velocity (max slope in a plot of signal versus time in a DETECTR assay) divided by the amount of programmable nuclease complexed with the guide nucleic acid present in the DETECTR assay, wherein the programmable nuclease is at saturation with respect to its active site for transcollateral cleavage of detector nucleic acids.

Turnover rate can be quantified with the following equation:

$$\text{Turnover rate} = \frac{\text{maximum transcleaving velocity}\left(\frac{AU}{\min}\right) / \text{signal normalization factor}\left(\frac{AU}{nM}\right)}{\text{concentration of programmanble nucleasecomplexed with guide nucleic acid (nM)}}$$

Signal normalization factor is based on a standard curve and is the amount of signal produced from a known quantity of detector nucleic acid (substrate of transcollateral cleavage). The turnover rate is, thus, expressed as cleaved detector nucleic acid molecules per minute divided by the concentration of the programmable nuclease complexed with guide nucleic acid (can also be referred to as "nucleoprotein" or "ribonucleoprotein"). Therefore, a programmable nuclease with a high turnover rate exhibits superior and highly efficient transcollateral cleavage of detector nucleic acids in the DETECTR assay methods disclosed herein. For example, a programmable nuclease having at least 60% sequence identity to SEQ ID NO: 11 can exhibit high a turnover rate of at least about 0.1 cleaved detector molecules per minute. A programmable nuclease having a sequence of SEQ ID NO: 11 exhibits a turnover rate of at least about 0.1 cleaved detector molecules per minute. For example, a programmable nuclease (e.g., SEQ ID NO: 11) that recognizes a PAM of YYN complexed with a guide nucleic acid comprises a turnover rate of at least about 0.1 cleaved detector molecules per minute. The programmable nuclease may be a Type V programmable nuclease. The programmable nuclease may be a Cas12 programmable nuclease. A programmable nuclease having a sequence of SEQ ID NO: 11 exhibits a turnover rate that is higher than the turnover rate of SEQ ID NO: 1. For example, a programmable nuclease having a sequence of SEQ ID NO: 11 can exhibit a turnover rate that is at least about 2-fold higher than the turnover rate of SEQ ID NO: 1. In some embodiments, a programmable nuclease having a sequence of SEQ ID NO: 11 can exhibit a turnover rate that is at about 2-fold higher than the turnover rate of SEQ ID NO: 1. In some embodiments, a programmable nuclease having a sequence of SEQ ID NO: 11 complexed with a guide nucleic acid can exhibit a turnover rate that is at least about 2-fold higher than the turnover rate of SEQ ID NO: 1 complexed with a guide nucleic acid. Thus, a programmable nuclease of SEQ ID NO: 11 is superior and more efficient at transcollateral cleavage in the DETECTR assay methods disclosed herein than a programmable nuclease of SEQ ID NO: 1.

In some embodiments, programmable nucleases with a high turnover rate have a turnover rate of at least about 0.1 cleaved detector molecules per minute. In some embodiments, programmable nucleases with a high turnover rate have a turnover rate of at least about 0.5 cleaved detector molecules per minute. In some embodiments, programmable nucleases with a high turnover rate have a turnover rate of at least about 1 cleaved detector molecules per minute. In some embodiments, programmable nucleases with a high turnover rate have a turnover rate of at least about 2 cleaved detector molecules per minute. In some embodiments, programmable nucleases with a high turnover rate have a turnover rate of at least about 3 cleaved detector molecules per minute. In some embodiments, programmable nucleases with a high turnover rate have a turnover rate of at least about 4 cleaved detector molecules per minute. In some embodiments, programmable nucleases with a high turnover rate have a turnover rate of at least about 5 cleaved detector molecules per minute. In some embodiments, programmable nucleases with a high turnover rate have a turnover rate of at least about 10 cleaved detector molecules per minute. In some embodiments, programmable nucleases with a high turnover rate have a turnover rate of at least about 15 cleaved detector molecules per minute. In some embodiments, programmable nucleases with a high turnover rate have a turnover rate of at least about 20 cleaved detector molecules per minute. In some embodiments, programmable nucleases with a high turnover rate have a turnover rate of at least about 25 cleaved detector molecules per minute. In some embodiments, programmable nucleases with a high turnover rate have a turnover rate of at least about 30 cleaved detector molecules per minute. In some embodiments, programmable nucleases with a high turnover rate have a turnover rate of at least about 35 cleaved detector molecules per minute. In some embodiments, programmable nucleases with a high turnover rate have a turnover rate of at least about 40 cleaved detector molecules per minute. In some embodiments, programmable nucleases with a high turnover rate have a turnover rate of at least about 45 cleaved detector molecules per minute. In some embodiments, programmable nucleases with a high turnover rate have a turnover rate of at least about 50 cleaved detector molecules per minute. In some embodiments, programmable nucleases with a high turnover rate have a turnover rate of at least about 60 cleaved detector molecules per minute. In some embodiments, programmable nucleases with a high turnover rate have a turnover rate of at least about 70 cleaved detector molecules per minute. In some embodiments, programmable nucleases with a high turnover rate have a turnover rate of at least about 80 cleaved detector molecules per minute. In some embodiments, programmable nucleases with a high turnover rate have a turnover rate of at least about 90 cleaved detector molecules per minute. In some embodiments, programmable nucleases with a high turnover rate have a turnover rate of at least about 100 cleaved detector molecules per minute. In some embodiments, programmable nucleases with a high turnover rate have a turnover rate of at least about 0.1 to 0.5 cleaved detector molecules per minute. In some embodiments, programmable nucleases with a high turnover rate have a turnover rate of at least about 0.5 to 1 cleaved detector molecules per minute. In some embodiments, programmable nucleases with a high turnover rate have a turnover rate of at least about 1 to 1.5 cleaved detector molecules per minute. In some embodiments, programmable nucleases with a high turnover rate have a turnover rate of at least about 1.5 to 2 cleaved detector molecules per minute. In some embodiments, programmable nucleases with a high turnover rate have a turnover rate of at least about 2 to 2.5 cleaved detector molecules per minute. In some embodiments, programmable nucleases with a high turnover rate have a turnover rate of at least about 2.5 to 3 cleaved detector molecules per minute. In some embodiments, programmable nucleases with a high turnover rate have a turnover rate of at least about 3 to 3.5 cleaved detector molecules per minute. In some embodiments, programmable nucleases with a high turnover rate have a turnover rate of at least about 3.5 to 4 cleaved detector molecules per minute. In some embodiments, programmable nucleases with a high turnover rate have a turnover rate of at least about 4 to 4.5 cleaved detector molecules per minute. In some embodiments, programmable nucleases with a high turnover rate have a turnover rate of at least about 4.5 to 5 cleaved detector molecules per minute. In some embodiments, programmable nucleases with a high turnover rate have a turnover rate of at least about 5 to 10 cleaved detector molecules per minute.

In some embodiments, programmable nucleases with a high turnover rate have a turnover rate of at least about 10 to 15 cleaved detector molecules per minute. In some embodiments, programmable nucleases with a high turnover rate have a turnover rate of at least about 15 to 20 cleaved detector molecules per minute. In some embodiments, programmable nucleases with a high turnover rate have a turnover rate of at least about 20 to 25 cleaved detector molecules per minute. In some embodiments, programmable nucleases with a high turnover rate have a turnover rate of at least about 25 to 30 cleaved detector molecules per minute. In some embodiments, programmable nucleases with a high turnover rate have a turnover rate of at least about 30 to 35 cleaved detector molecules per minute. In some embodiments, programmable nucleases with a high turnover rate have a turnover rate of at least about 35 to 40 cleaved detector molecules per minute. In some embodiments, programmable nucleases with a high turnover rate have a turnover rate of at least about 40 to 45 cleaved detector molecules per minute. In some embodiments, programmable nucleases with a high turnover rate have a turnover rate of at least about 45 to 50 cleaved detector molecules per minute. In some embodiments, programmable nucleases with a high turnover rate have a turnover rate of at least about 50 to 60 cleaved detector molecules per minute. In some embodiments, programmable nucleases with a high turnover rate have a turnover rate of at least about 60 to 70 cleaved detector molecules per minute. In some embodiments, programmable nucleases with a high turnover rate have a turnover rate of at least about 70 to 80 cleaved detector molecules per minute. In some embodiments, programmable nucleases with a high turnover rate have a turnover rate of at least about 80 to 90 cleaved detector molecules per minute. In some embodiments, programmable nucleases with a high turnover rate have a turnover rate of at least about 90 to 100 cleaved detector molecules per minute.

Guide Nucleic Acids

The reagents of this disclosure may comprise a guide nucleic acid. The guide nucleic acid can bind to a single stranded target nucleic acid or portion thereof as described herein. For example, the guide nucleic acid can bind to a target nucleic acid such as nucleic acid from a virus or a bacterium or other agents responsible for a disease, or an amplicon thereof, as described herein. The guide nucleic acid can bind to a target nucleic acid such as a nucleic acid from a bacterium, a virus, a parasite, a protozoa, a fungus or other agents responsible for a disease, or an amplicon thereof, as described herein and further comprising a mutation, such as a single nucleotide polymorphism (SNP), which can confer resistance to a treatment, such as antibiotic treatment. The guide nucleic acid can bind to a target nucleic acid such as a nucleic acid, preferably DNA, from a cancer gene or gene associated with a genetic disorder, or an amplicon thereof, as described herein. The guide nucleic acid comprises a segment of nucleic acids that are reverse complementary to the target nucleic acid. Often the guide nucleic acid binds specifically to the target nucleic acid. The target nucleic acid may be a reversed transcribed RNA, DNA, DNA amplicon, or synthetic nucleic acids. The target nucleic acid can be a single-stranded DNA or DNA amplicon of a nucleic acid of interest. A guide nucleic acid may be a non-naturally occurring guide nucleic acid. A non-naturally occurring guide nucleic acid may comprise an engineered sequence having a repeat and a spacer that hybridizes to a target nucleic acid sequence of interest. A non-naturally occurring guide nucleic acid may be recombinantly expressed or chemically synthezised.

A guide nucleic acid (gRNA) sequence (e.g., a non-naturally occurring gRNA) may hybridize to a target sequence of a target nucleic acid. The term "gRNA" may be used interchangeably with the term "crRNA." A gRNA comprises a repeat region corresponding to a specific programmable nuclease (e.g., a Cas protein), for example the repeat sequences provided in TABLE 30. In some embodiments, the repeat region may comprise mutations or truncations with respect to the repeat sequences in pre-crRNA. The repeat sequence interacts with the programmable nuclease (e.g., a Cas protein), allowing for the gRNA and the programmable nuclease to form a complex. This complex may be referred to as a nucleoprotein. A spacer sequence may be positioned 3' of the repeat region. The spacer sequence may hybridize to a target sequence of the target nucleic acid, where the target sequence is a segment of a target nucleic acid. The spacer sequences may be reverse complementary to the target sequence. In some cases, the spacer sequence may be sufficiently reverse complementary to a target sequence to allow for hybridization, however, may not necessarily be 100% reverse complementary. In some embodiments, a programmable nuclease (e.g., a Cas protein) may cleave a precursor RNA ("pre-crRNA") to produce a gRNA, also referred to as a "mature guide RNA." A programmable nuclease (e.g., a Cas protein) that cleaves pre-crRNA to produce a mature guide RNA is said to have pre-crRNA processing activity.

A guide nucleic acid can comprise a sequence that is, at least in part, reverse complementary to the sequence of a target nucleic acid. The guide nucleic acid may be a non-naturally occurring guide nucleic acid. A non-naturally occurring guide nucleic acid may comprise an engineered sequence having a repeat and a spacer that hybridizes to a target nucleic acid sequence of interest. A non-naturally occurring guide nucleic acid may be recombinantly expressed or chemically synthezised. A guide nucleic acid can be a crRNA. Sometimes, a guide nucleic acid comprises a crRNA and tracrRNA. The guide nucleic acid can bind specifically to the target nucleic acid. In some cases, the guide nucleic acid is not naturally occurring and made by artificial combination of otherwise separate segments of sequence. Often, the artificial combination is performed by chemical synthesis, by genetic engineering techniques, or by the artificial manipulation of isolated segments of nucleic acids. In some cases, the segment of a guide nucleic acid that comprises a sequence that is reverse complementary to the target nucleic acid is 20 nucleotides in length. A guide nucleic acid can have at least 10, 11, 12, 13, 14, 15, 16, 17, 18, 19, 20, 21, 22, 23, 24, 25, 26, 27, 28, 29, or 30 nucleotides reverse complementary to a target nucleic acid. In some cases, the guide nucleic acid can be 10, 11, 12, 13, 14, 15, 16, 17, 18, 19, 20, 21, 22, 23, 24, 25, 26, 27, 28, 29, or 30 nucleotides in length. For example, a guide nucleic acid may be at least 10 bases. In some embodiments, a guide nucleic acid may be from 10 to 50 bases. In some embodiments, a guide nucleic acid may be at least 25 bases. In some cases, the guide nucleic acid has from exactly or about 12 nucleotides (nt) to about 80 nt, from about 12 nt to about 50 nt, from about 12 nt to about 45 nt, from about 12 nt to about 40 nt, from about 12 nt to about 35 nt, from about 12 nt to about 30 nt, from about 12 nt to about 25 nt, from about 12 nt to about 20 nt, from about 12 nt to about 19 nt, from about 19 nt to about 20 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt reverse complementary to a target nucleic acid. In some cases, the guide nucleic acid has from about 10 nt to about 60 nt, from about 20 nt to about 50 nt, or from about 30 nt to about 40 nt reverse complementary to a target nucleic acid. It is understood that the sequence of a guide nucleic acid need not be 100% reverse complementary to that of its target nucleic acid to be specifically hybridizable, hybridizable, or bind specifically. The guide nucleic acid can have a sequence comprising at least one uracil in a region from nucleic acid residue 5 to 20 that is reverse complementary to a modification variable region in the target nucleic acid. The guide nucleic acid, in some cases, has a sequence comprising at least one uracil in a region from nucleic acid residue 5 to 9, 10 to 14, or 15 to 20 that is reverse complementary to a modification variable region in the target nucleic acid. The guide nucleic acid can have a sequence comprising at least one uracil in a region from nucleic acid residue 5 to 20 that is reverse complementary to a methylation variable region in the target nucleic acid. The guide nucleic acid, in some cases, has a sequence comprising at least one uracil in a region from nucleic acid residue 5 to 9, 10 to 14, or 15 to 20 that is reverse complementary to a methylation variable region in the target nucleic acid. The guide nucleic acid can hybridize with a target nucleic acid.

The guide nucleic acid (e.g., a non-naturally occurring guide nucleic acid) can be selected from a group of guide nucleic acids that have been tiled against the nucleic acid sequence of a strain of an infection or genomic locus of interest. The guide nucleic acid can be selected from a group of guide nucleic acids that have been tiled against the nucleic acid sequence of a strain of HPV 16 or HPV18. Often, guide nucleic acids that are tiled against the nucleic acid of a strain of an infection or genomic locus of interest can be pooled for use in a method described herein. Often, these guide nucleic acids are pooled for detecting a target nucleic acid in a single assay. The pooling of guide nucleic acids that are tiled against a single target nucleic acid can enhance the detection of the target nucleic using the methods described herein. The pooling of guide nucleic acids that are tiled against a single target nucleic acid can ensure broad coverage of the target nucleic acid within a single reaction using the methods described herein. The tiling, for example, is sequential along the target nucleic acid. Sometimes, the tiling is overlapping along the target nucleic acid. In some instances, the tiling comprises gaps between the tiled guide nucleic acids along the target nucleic acid. In some instances, the tiling of the guide nucleic acids is non-sequential. Often, a method for detecting a target nucleic acid comprises contacting a target nucleic acid to a pool of guide nucleic acids and a programmable nuclease, wherein a guide nucleic acid sequence of the pool of guide nucleic acids has a sequence selected from a group of tiled guide nucleic acid that correspond to nucleic acid sequence of a target nucleic acid; and assaying for a signal produce by cleavage of at least some nucleic acids of a reporter of a population of nucleic acids of a reporter. Pooling of guide nucleic acids can ensure broad spectrum identification, or broad coverage, of a target species within a single reaction. This can be particularly helpful in diseases or indications, like sepsis, that may be caused by multiple organisms.

Reporters

Described herein are reagents comprising a reporter. The reporter can comprise a single stranded nucleic acid and a detection moiety, wherein the nucleic acid is capable of being cleaved by the activated programmable nuclease, releasing the detection moiety, and, generating a detectable signal. As used herein, "reporter" is used interchangeably with "detector nucleic acid" or "reporter molecule". The programmable nucleases disclosed herein, activated upon hybridization of a guide RNA to a target nucleic acid, can cleave the reporter. Cleaving the "reporter" may be referred to herein as cleaving the "detector nucleic acid," the "reporter molecule," or the "nucleic acid of the reporter."

A major advantage of the compositions and methods disclosed herein is the design of excess reporters to total nucleic acids in an unamplified or an amplified sample, not including the nucleic acid of the reporter. Total nucleic acids can include the target nucleic acids and non-target nucleic acids, not including the nucleic acid of the reporter. The non-target nucleic acids can be from the original sample, either lysed or unlysed. The non-target nucleic acids can also be byproducts of amplification. Thus, the non-target nucleic acids can include both non-target nucleic acids from the original sample, lysed or unlysed, and from an amplified sample. The presence of a large amount of non-target nucleic acids, an activated programmable nuclease may be inhibited in its ability to bind and cleave the reporter sequences. This is because the activated programmable nucleases collaterally cleaves any nucleic acids. If total nucleic acids are in present in large amounts, they may outcompete reporters for the programmable nucleases. The compositions and methods disclosed herein are designed to have an excess of reporter to total nucleic acids, such that the detectable signals from DETECTR reactions are particularly superior. In some embodiments, the reporter can be present in at least 1.5 fold, at least 2 fold, at least 3 fold, at least 4 fold, at least 5 fold, at least 6 fold, at least 7 fold, at least 8 fold, at least 9 fold, at least 10 fold, at least 11 fold, at least 12 fold, at least 13 fold, at least 14 fold, at least 15 fold, at least 16 fold, at least 17 fold, at least 18 fold, at least 19 fold, at least 20 fold, at least 30 fold, at least 40 fold, at least 50 fold, at least 60 fold, at least 70 fold, at least 80 fold, at least 90 fold, at least 100 fold, from 1.5 fold to 100 fold, from 2 fold to 10 fold, from 10 fold to 20 fold, from 20 fold to 30 fold, from 30 fold to 40 fold, from 40 fold to 50 fold, from 50 fold to 60 fold, from 60 fold to 70 fold, from 70 fold to 80 fold, from 80 fold to 90 fold, from 90 fold to 100 fold, from 1.5 fold to 10 fold, from 1.5 fold to 20 fold, from 10 fold to 40 fold, from 20 fold to 60 fold, or from 10 fold to 80 fold excess of total nucleic acids.

A second significant advantage of the compositions and methods disclosed herein is the design of an excess volume comprising the guide nucleic acid, the programmable nuclease, and the reporter, which contacts a smaller volume comprising the sample with the target nucleic acid of interest. The smaller volume comprising the sample can be unlysed sample, lysed sample, or lysed sample which has undergone any combination of reverse transcription, amplification, and in vitro transcription. The presence of various reagents in a crude, non-lysed sample, a lysed sample, or a lysed and amplified sample, such as buffer, magnesium sulfate, salts, the pH, a reducing agent, primers, dNTPs, NTPs, cellular lysates, non-target nucleic acids, primers, or other components, can inhibit the ability of the programmable nuclease to become activated or to find and cleave the nucleic acid of the reporter. This may be due to nucleic acids that are not the reporter outcompeting the nucleic acid of the reporter, for the programmable nuclease. Alternatively, various reagents in the sample may simply inhibit the activity of the programmable nuclease. Thus, the compositions and methods provided herein for contacting an excess volume comprising the guide nucleic acid, the programmable nuclease, and the reporter to a smaller volume comprising the sample with the target nucleic acid of interest provides for superior detection of the target nucleic acid by ensuring that the programmable nuclease is able to find and cleaves the nucleic acid of the reporter. In some embodiments, the volume comprising the guide nucleic acid, the programmable nuclease, and the reporter (can be referred to as "a second volume") is 4-fold greater than a volume comprising the sample (can be referred to as "a first volume"). In some embodiments, the volume comprising the guide nucleic acid, the programmable nuclease, and the reporter (can be referred to as "a second volume") is at least 1.5 fold, at least 2 fold, at least 3 fold, at least 4 fold, at least 5 fold, at least 6 fold, at least 7 fold, at least 8 fold, at least 9 fold, at least 10 fold, at least 11 fold, at least 12 fold, at least 13 fold, at least 14 fold, at least 15 fold, at least 16 fold, at least 17 fold, at least 18 fold, at least 19 fold, at least 20 fold, at least 30 fold, at least 40 fold, at least 50 fold, at least 60 fold, at least 70 fold, at least 80 fold, at least 90 fold, at least 100 fold, from 1.5 fold to 100 fold, from 2 fold to 10 fold, from 10 fold to 20 fold, from 20 fold to 30 fold, from 30 fold to 40 fold, from 40 fold to 50 fold, from 50 fold to 60 fold, from 60 fold to 70 fold, from 70 fold to 80 fold, from 80 fold to 90 fold, from 90 fold to 100 fold, from 1.5 fold to 10 fold, from 1.5 fold to 20 fold, from 10 fold to 40 fold, from 20 fold to 60 fold, or from 10 fold to 80 fold greater than a volume comprising the sample (can be referred to as "a first volume"). In some embodiments, the volume comprising the sample is at least 0.5 µL, at least 1 µL, at least at least 1 µL, at least 2 µL, at least 3 µL, at least 4 µL, at least 5 µL, at least 6 µL, at least 7 µL, at least 8 µL, at least 9 µL, at least 10 µL, at least 11 µL, at least 12 µL, at least 13 µL, at least 14 µL, at least 15 µL, at least 16 µL, at least 17 µL, at least 18 µL, at least 19 µL, at least 20 µL, at least 25 µL, at least 30 µL, at least 35 µL, at least 40 µL, at least 45 µL, at least 50 µL, at least 55 µL, at least 60 µL, at least 65 µL, at least 70 µL, at least 75 µL, at least 80 µL, at least 85 µL, at least 90 µL, at least 95 µL, at least 100 µL, from 0.5 µL to 5 µL µL, from 5 µL to 10 µL, from 10 µL to 15 µL, from 15 µL to 20 µL, from 20 µL to 25 µL, from 25 µL to 30 µL, from 30 µL to 35 µL, from 35 µL to 40 µL, from 40 µL to 45 µL, from 45 µL to 50 µL, from 10 µL to 20 µL, from 5 µL to 20 µL, from 1 µL to 40 µL, from 2 µL to 10 µL, or from 1 µL to 10 µL. In some embodiments, the volume comprising the programmable nuclease, the guide nucleic acid, and the reporter is at least 10 µL, at least 11 µL, at least 12 µL, at least 13 µL, at least 14 µL, at least 15 µL, at least 16 µL, at least 17 µL, at least 18 µL, at least 19 µL, at least 20 µL, at least 21 µL, at least 22 µL, at least 23 µL, at least 24 µL, at least 25 µL, at least 26 µL, at least 27 µL, at least 28 µL, at least 29 µL, at least 30 µL, at least 40 µL, at least 50 µL, at least 60 µL, at least 70 µL, at least 80 µL, at least 90 µL, at least 100 µL, at least 150 µL, at least 200 µL, at least 250 µL, at least 300 µL, at least 350 µL, at least 400 µL, at least 450 µL, at least 500 µL, from 10 µL to 15 µL µL, from 15 µL to 20 µL, from 20 µL to 25 µL, from 25 µL to 30 µL, from 30 µL to 35 µL, from 35 µL to 40 µL, from 40 µL to 45 µL, from 45 µL to 50 µL, from 50 µL to 55 µL, from 55 µL to 60 µL, from 60 µL to 65 µL, from 65 µL to 70 µL, from 70 µL to 75 µL, from 75 µL to 80 µL, from 80 µL to 85 µL, from 85 µL to 90 µL, from 90 µL to 95 µL, from 95 µL to 100 µL, from 100 µL to 150 µL, from 150 µL to 200 µL, from 200 µL to 250 µL, from 250 µL to 300 µL, from 300 µL to 350 µL, from 350 µL to 400 µL, from 400 µL to 450 µL, from 450 µL to 500 µL, from 10 µL to 20 µL, from 10 µL to 30 µL, from 25 µL to 35 µL, from 10 µL to 40 µL, from 20 µL to 50 µL, from 18 µL to 28 µL, or from 17 µL to 22 µL.

As described herein, nucleic acid sequences comprising DNA may be detected using a DNA-activated programmable RNA nuclease, a DNA-activated programmable DNA nuclease, an RNA-activated programmable RNA nuclease, or any combination thereof, and other reagents disclosed herein. The DNA-activated programmable RNA nuclease may be activated and cleave an RNA reporter upon binding of a guide nucleic acid to a target DNA. In some cases, the reporter comprises a nucleic acid, which is a single-stranded nucleic acid sequence comprising ribonucleotides. Additionally, detection by a DNA-activated programmable RNA nuclease, which can cleave RNA reporters, allows for multiplexing with a DNA-activated programmable DNA nuclease that can cleave DNA reporters (e.g., Type V CRISPR enzyme). In some cases, the nucleic acid of a reporter is a single-stranded nucleic acid sequence comprising deoxyribonucleotides.

The nucleic acid of a reporter can be a single-stranded nucleic acid sequence comprising at least one deoxyribonucleotide and at least one ribonucleotide. In some cases, the nucleic acid of a reporter is a single-stranded nucleic acid comprising at least one ribonucleotide residue at an internal position that functions as a cleavage site. In some cases, the nucleic acid of a reporter comprises at least 2, 3, 4, 5, 6, 7, 8, 9, or 10 ribonucleotide residues at an internal position. In some cases, the nucleic acid of a reporter comprises from 2 to 10, from 3 to 9, from 4 to 8, or from 5 to 7 ribonucleotide residues at an internal position. Sometimes the ribonucleotide residues are continuous. Alternatively, the ribonucleotide residues are interspersed in between non-ribonucleotide residues. In some cases, the nucleic acid of a reporter has only ribonucleotide residues. In some cases, the nucleic acid of a reporter has only deoxyribonucleotide residues. In some cases, the nucleic acid comprises nucleotides resistant to cleavage by the programmable nuclease described herein. In some cases, the nucleic acid of a reporter comprises synthetic nucleotides. In some cases, the nucleic acid of a reporter comprises at least one ribonucleotide residue and at least one non-ribonucleotide residue. In some cases, the nucleic acid of a reporter is 5-20, 5-15, 5-10, 7-20, 7-15, or 7-10 nucleotides in length. In some cases, the nucleic acid of a reporter is from 3 to 20, from 4 to 10, from 5 to 10, or from 5 to 8 nucleotides in length. In some cases, the nucleic acid of a reporter comprises at least one uracil ribonucleotide. In some cases, the nucleic acid of a reporter comprises at least two uracil ribonucleotides. Sometimes the nucleic acid of a reporter has only uracil ribonucleotides. In some cases, the nucleic acid of a reporter comprises at least one adenine ribonucleotide. In some cases, the nucleic acid of a reporter comprises at least two adenine ribonucleotide. In some cases, the nucleic acid of a reporter has only adenine ribonucleotides. In some cases, the nucleic acid of a reporter comprises at least one cytosine ribonucleotide. In some cases, the nucleic acid of a reporter comprises at least two cytosine ribonucleotide. In some cases, the nucleic acid of a reporter comprises at least one guanine ribonucleotide. In some cases, the nucleic acid of a reporter comprises at least two guanine ribonucleotide. A nucleic acid of a reporter can comprise only unmodified ribonucleotides, only unmodified deoxyribonucleotides, or a combination thereof. In some cases, the nucleic acid of a reporter is from 5 to 12 nucleotides in length. In some cases, the nucleic acid of a reporter is at least 2, 3, 4, 5, 6, 7, 8, 9, 10, 11, 12, 13, 14, 15, 16, 17, 18, 19, 20, 21, 22, 23, 24, 25, 26, 27, 28, 29, or 30 nucleotides in length. In some cases, the nucleic acid of a reporter is 2, 3, 4, 5, 6, 7, 8, 9, 10, 11, 12, 13, 14, 15, 16, 17, 18, 19, 20, 21, 22, 23, 24, 25, 26, 27, 28, 29, or 30 nucleotides in length. For cleavage by a programmable nuclease comprising Cas13, a nucleic acid of a reporter can be 5, 8, or 10 nucleotides in length. For cleavage by a programmable nuclease comprising Cas12, a nucleic acid of a reporter can be 10 nucleotides in length.

The single stranded nucleic acid of a reporter comprises a detection moiety capable of generating a first detectable signal. Sometimes the detector nucleic acid comprises a protein capable of generating a signal. A signal can be a calorimetric, potentiometric, amperometric, optical (e.g., fluorescent, colorimetric, etc.), or piezo-electric signal. In some cases, a detection moiety is on one side of the cleavage site. Optionally, a quenching moiety is on the other side of the cleavage site. Sometimes the quenching moiety is a fluorescence quenching moiety. In some cases, the quenching moiety is 5' to the cleavage site and the detection moiety is 3' to the cleavage site. In some cases, the detection moiety is 5' to the cleavage site and the quenching moiety is 3' to the cleavage site. Sometimes the quenching moiety is at the 5' terminus of the nucleic acid of a reporter. Sometimes the detection moiety is at the 3' terminus of the nucleic acid of a reporter. In some cases, the detection moiety is at the 5' terminus of the nucleic acid of a reporter. In some cases, the quenching moiety is at the 3' terminus of the nucleic acid of a reporter. In some cases, the single-stranded nucleic acid of a reporter is at least one population of the single-stranded nucleic acid capable of generating a first detectable signal. In some cases, the single-stranded nucleic acid of a reporter is a population of the single stranded nucleic acid capable of generating a first detectable signal. Optionally, there is more than one population of single-stranded nucleic acid of a reporter. In some cases, there are 2, 3, 4, 5, 6, 7, 8, 9, 10, 11, 12, 13, 14, 15, 20, 30, 40, 50, or greater than 50, or any number spanned by the range of this list of different populations of single-stranded nucleic acids of a reporter capable of generating a detectable signal. In some cases, there are from 2 to 50, from 3 to 40, from 4 to 30, from 5 to 20, or from 6 to 10 different populations of single-stranded nucleic acids of a reporter capable of generating a detectable signal.

TABLE 4

Exemplary Single Stranded Nucleic Acids in a Reporter

| 5' Detection Moiety* | Sequence (SEQ ID NO) | 3' Quencher* |
|---|---|---|
| /56-FAM/ | rUrUrUrUrU (SEQ ID NO: 111) | /3IABkFQ/ |
| /5IRD700/ | rUrUrUrUrU (SEQ ID NO: 111) | /3IRQC1N/ |
| /5TYE665/ | rUrUrUrUrU (SEQ ID NO: 111) | /3IAbRQSp/ |
| /5Alex594N/ | rUrUrUrUrU (SEQ ID NO: 111) | /3IAbRQSp/ |
| /5ATTO633N/ | rUrUrUrUrU (SEQ ID NO: 111) | /3IAbRQSp/ |
| /56-FAM/ | rUrUrUrUrUrUrU (SEQ ID NO: 112) | /3IABkFQ/ |
| /5IRD700/ | rUrUrUrUrUrUrU (SEQ ID NO: 112) | /3IRQC1N/ |
| /5TYE665/ | rUrUrUrUrUrUrU (SEQ ID NO: 112) | /3IAbRQSp/ |
| /5Alex594N/ | rUrUrUrUrUrUrU (SEQ ID NO: 112) | /3IAbRQSp/ |
| /5ATTO633N/ | rUrUrUrUrUrUrU (SEQ ID NO: 112) | /3IAbRQSp/ |
| /56-FAM/ | rUrUrUrUrUrUrUrUrU (SEQ ID NO: 113) | /3IABkFQ/ |
| /5IRD700/ | rUrUrUrUrUrUrUrUrU (SEQ ID NO: 113) | /3IRQC1N/ |
| /5TYE665/ | rUrUrUrUrUrUrUrUrU (SEQ ID NO: 113) | /3IAbRQSp/ |
| /5Alex594N/ | rUrUrUrUrUrUrUrUrU (SEQ ID NO: 113) | /3IAbRQSp/ |
| /5ATTO633N/ | rUrUrUrUrUrUrUrUrU (SEQ ID NO: 113) | /3IAbRQSp/ |
| /56-FAM/ | TTTTrUrUTTTT (SEQ ID NO: 114) | /3IABkFQ/ |
| /5IRD700/ | TTTTrUrUTTTT (SEQ ID NO: 114) | /3IRQC1N/ |
| /5TYE665/ | TTTTrUrUTTTT (SEQ ID NO: 114) | /3IAbRQSp/ |
| /5Alex594N/ | TTTTrUrUTTTT (SEQ ID NO: 114) | /3IAbRQSp/ |
| /5ATTO633N/ | TTTTrUrUTTTT (SEQ ID NO: 114) | /3IAbRQSp/ |
| /56-FAM/ | TTrUrUTT (SEQ ID NO: 115) | /3IABkFQ/ |
| /5IRD700/ | TTrUrUTT (SEQ ID NO: 115) | /3IRQC1N/ |
| /5TYE665/ | TTrUrUTT (SEQ ID NO: 115) | /3IAbRQSp/ |
| /5Alex594N/ | TTrUrUTT (SEQ ID NO: 115) | /3IAbRQSp/ |

TABLE 4-continued

Exemplary Single Stranded Nucleic Acids in a Reporter

| 5' Detection Moiety* | Sequence (SEQ ID NO) | 3' Quencher* |
|---|---|---|
| /5ATTO633N/ | TTrUrUTT (SEQ ID NO: 115) | /3IAbRQSp/ |
| /56-FAM/ | TArArUGC (SEQ ID NO: 116) | /3IABkFQ/ |
| /5IRD700/ | TArArUGC (SEQ ID NO: 116) | /3IRQC1N/ |
| /5TYE665/ | TArArUGC (SEQ ID NO: 116) | /3IAbRQSp/ |
| /5Alex594N/ | TArArUGC (SEQ ID NO: 116) | /3IAbRQSp/ |
| /5ATTO633N/ | TArArUGC (SEQ ID NO: 116) | /3IAbRQSp/ |
| /56-FAM/ | TArUrGGC (SEQ ID NO: 117) | /3IABkFQ/ |
| /5IRD700/ | TArUrGGC (SEQ ID NO: 117) | /3IRQC1N/ |
| /5TYE665/ | TArUrGGC (SEQ ID NO: 117) | /3IAbRQSp/ |
| /5Alex594N/ | TArUrGGC (SEQ ID NO: 117) | /3IAbRQSp/ |
| /5ATTO633N/ | TArUrGGC (SEQ ID NO: 117) | /3IAbRQSp/ |
| /56-FAM/ | rUrUrUrUrU (SEQ ID NO: 118) | /3IABkFQ/ |
| /5IRD700/ | rUrUrUrUrU (SEQ ID NO: 118) | /3IRQC1N/ |
| /5TYE665/ | rUrUrUrUrU (SEQ ID NO: 118) | /3IAbRQSp/ |
| /5Alex594N/ | rUrUrUrUrU (SEQ ID NO: 118) | /3IAbRQSp/ |
| /5ATTO633N/ | rUrUrUrUrU (SEQ ID NO: 118) | /3IAbRQSp/ |
| /56-FAM/ | TTATTATT (SEQ ID NO: 119) | /3IABkFQ/ |
| /56-FAM/ | TTATTATT (SEQ ID NO: 119) | /3IABkFQ/ |
| /5IRD700/ | TTATTATT (SEQ ID NO: 119) | /3IRQC1N/ |
| /5TYE665/ | TTATTATT (SEQ ID NO: 119) | /3IAbRQSp/ |
| /5Alex594N/ | TTATTATT (SEQ ID NO: 119) | /3IAbRQSp/ |
| /5ATTO633N/ | TTATTATT (SEQ ID NO: 119) | /3IAbRQSp/ |
| /56-FAM/ | TTTTTT (SEQ ID NO: 120) | /3IABkFQ/ |
| /56-FAM/ | TTTTTTT (SEQ ID NO: 121) | /3IABkFQ/ |
| /56-FAM/ | TTTTTTTTT (SEQ ID NO: 122) | /3IABkFQ/ |
| /56-FAM/ | TTTTTTTTTT (SEQ ID NO: 123) | /3IABkFQ/ |
| /56-FAM/ | TTTTTTTTTTTT (SEQ ID NO: 124) | /3IABkFQ/ |
| /56-FAM/ | AAAAAA (SEQ ID NO: 125) | /3IABkFQ/ |
| /56-FAM/ | CCCCCC (SEQ ID NO: 126) | /3IABkFQ/ |

TABLE 4-continued

Exemplary Single Stranded Nucleic Acids in a Reporter

| 5' Detection Moiety* | Sequence (SEQ ID NO) | 3' Quencher* |
|---|---|---|
| /56-FAM/ | GGGGGG (SEQ ID NO: 127) | /3IABkFQ/ |
| /56-FAM/ | TTATTATT (SEQ ID NO: 119) | /3IABkFQ/ |

/56-FAM/: 5' 6-Fluorescein (Integrated DNA Technologies)
/3IABkFQ/: 3' Iowa Black FQ (Integrated DNA Technologies)
/5IRD700/: 5' IRDye 700 (Integrated DNA Technologies)
/5TYE665/: 5' TYE 665 (Integrated DNA Technologies)
/5Alex594N/: 5' Alexa Fluor 594 (NHS Ester) (Integrated DNA Technologies)
/5ATTO633N/: 5' ATTO TM 633 (NHS Ester) (Integrated DNA Technologies)
/3IRQC1N/: 3' IRDye QC-1 Quencher (Li-Cor)
/3IAbRQSp/: 3' Iowa Black RQ (Integrated DNA Technologies)
rU: uracil ribonucleotide
rG: guanine ribonucleotide
*This Table refers to the detection moiety and quencher moiety as their tradenames and their source is identified. However, alternatives, generics, or non-tradename moieties with similar function from other sources can also be used.

A detection moiety can be an infrared fluorophore. A detection moiety can be a fluorophore that emits fluorescence in the range of from 500 nm and 720 nm. A detection moiety can be a fluorophore that emits fluorescence in the range of from 500 nm and 720 nm. In some cases, the detection moiety emits fluorescence at a wavelength of 700 nm or higher. In other cases, the detection moiety emits fluorescence at about 660 nm or about 670 nm. In some cases, the detection moiety emits fluorescence in the range of from 500 to 520, 500 to 540, 500 to 590, 590 to 600, 600 to 610, 610 to 620, 620 to 630, 630 to 640, 640 to 650, 650 to 660, 660 to 670, 670 to 680, 690 to 690, 690 to 700, 700 to 710, 710 to 720, or 720 to 730 nm. In some cases, the detection moiety emits fluorescence in the range from 450 nm to 750 nm, from 500 nm to 650 nm, or from 550 to 650 nm. A detection moiety can be a fluorophore that emits a detectable fluorescence signal in the same range as 6-Fluorescein, IRDye 700, TYE 665, Alex Fluor, or ATTO TM 633 (NHS Ester). A detection moiety can be fluorescein amidite, 6-Fluorescein, IRDye 700, TYE 665, Alex Fluor 594, or ATTO TM 633 (NHS Ester). A detection moiety can be a fluorophore that emits a fluorescence in the same range as 6-Fluorescein (Integrated DNA Technologies), IRDye 700 (Integrated DNA Technologies), TYE 665 (Integrated DNA Technologies), Alex Fluor 594 (Integrated DNA Technologies), or ATTO TM 633 (NHS Ester) (Integrated DNA Technologies). A detection moiety can be fluorescein amidite, 6-Fluorescein (Integrated DNA Technologies), IRDye 700 (Integrated DNA Technologies), TYE 665 (Integrated DNA Technologies), Alex Fluor 594 (Integrated DNA Technologies), or ATTO TM 633 (NHS Ester) (Integrated DNA Technologies). Any of the detection moieties described herein can be from any commercially available source, can be an alternative with a similar function, a generic, or a non-tradename of the detection moieties listed.

A detection moiety can be chosen for use based on the type of sample to be tested. For example, a detection moiety that is an infrared fluorophore is used with a urine sample. As another example, SEQ ID NO: 111 with a fluorophore that emits a fluorescence around 520 nm is used for testing in non-urine samples, and SEQ ID NO: 118 with a fluorophore that emits a fluorescence around 700 nm is used for testing in urine samples.

A quenching moiety can be chosen based on its ability to quench the detection moiety. A quenching moiety can be a non-fluorescent fluorescence quencher. A quenching moiety can quench a detection moiety that emits fluorescence in the range of from 500 nm and 720 nm. A quenching moiety can quench a detection moiety that emits fluorescence in the range of from 500 nm and 720 nm. In some cases, the quenching moiety quenches a detection moiety that emits fluorescence at a wavelength of 700 nm or higher. In other cases, the quenching moiety quenches a detection moiety that emits fluorescence at about 660 nm or about 670 nm. In some cases, the quenching moiety quenches a detection moiety that emits fluorescence in the range of from 500 to 520, 500 to 540, 500 to 590, 590 to 600, 600 to 610, 610 to 620, 620 to 630, 630 to 640, 640 to 650, 650 to 660, 660 to 670, 670 to 680, 690 to 690, 690 to 700, 700 to 710, 710 to 720, or 720 to 730 nm. In some cases, the quenching moiety quenches a detection moiety that emits fluorescence in the range from 450 nm to 750 nm, from 500 nm to 650 nm, or from 550 to 650 nm. A quenching moiety can quench fluorescein amidite, 6-Fluorescein, IRDye 700, TYE 665, Alex Fluor 594, or ATTO TM 633 (NHS Ester). A quenching moiety can be Iowa Black RQ, Iowa Black FQ or IRDye QC-1 Quencher. A quenching moiety can quench fluorescein amidite, 6-Fluorescein (Integrated DNA Technologies), IRDye 700 (Integrated DNA Technologies), TYE 665 (Integrated DNA Technologies), Alex Fluor 594 (Integrated DNA Technologies), or ATTO TM 633 (NHS Ester) (Integrated DNA Technologies). A quenching moiety can be Iowa Black RQ (Integrated DNA Technologies), Iowa Black FQ (Integrated DNA Technologies) or IRDye QC-1 Quencher (Li-Cor). Any of the quenching moieties described herein can be from any commercially available source, can be an alternative with a similar function, a generic, or a non-tradename of the quenching moieties listed.

The generation of the detectable signal from the release of the detection moiety indicates that cleavage by the programmable nuclease has occurred and that the sample contains the target nucleic acid. In some cases, the detection moiety comprises a fluorescent dye. Sometimes the detection moiety comprises a fluorescence resonance energy transfer (FRET) pair. In some cases, the detection moiety comprises an infrared (IR) dye. In some cases, the detection moiety comprises an ultraviolet (UV) dye. Alternatively or in combination, the detection moiety comprises a polypeptide. Sometimes the detection moiety comprises a biotin. Sometimes the detection moiety comprises at least one of avidin or streptavidin. In some instances, the detection moiety comprises a polysaccharide, a polymer, or a nanoparticle. In some instances, the detection moiety comprises a gold nanoparticle or a latex nanoparticle.

A detection moiety can be any moiety capable of generating a calorimetric, potentiometric, amperometric, optical (e.g., fluorescent, colorimetric, etc.), or piezo-electric signal. A nucleic acid of a reporter, sometimes, is protein-nucleic acid that is capable of generating a calorimetric, potentiometric, amperometric, optical (e.g., fluorescent, colorimetric, etc.), or piezo-electric signal upon cleavage of the nucleic acid. Often a calorimetric signal is heat produced after cleavage of the nucleic acids of a reporter. Sometimes, a calorimetric signal is heat absorbed after cleavage of the nucleic acids of a reporter. A potentiometric signal, for example, is electrical potential produced after cleavage of the nucleic acids of a reporter. An amperometric signal can be movement of electrons produced after the cleavage of nucleic acid of a reporter. Often, the signal is an optical signal, such as a colorimetric signal or a fluorescence signal. An optical signal is, for example, a light output produced after the cleavage of the nucleic acids of a reporter. Sometimes, an optical signal is a change in light absorbance between before and after the cleavage of nucleic acids of a reporter. Often, a piezo-electric signal is a change in mass between before and after the cleavage of the nucleic acid of a reporter.

Often, the protein-nucleic acid is an enzyme-nucleic acid. The enzyme may be sterically hindered when present as in the enzyme-nucleic acid, but then functional upon cleavage from the nucleic acid. Often, the enzyme is an enzyme that produces a reaction with a substrate. An enzyme can be invertase. Often, the substrate of invertase is sucrose. A DNS reagent produces a colorimetric change when invertase converts sucrose to glucose. In some cases, it is preferred that the nucleic acid (e.g., DNA) and invertase are conjugated using a heterobifunctional linker via sulfo-SMCC chemistry. Sometimes the protein-nucleic acid is a substrate-nucleic acid. Often the substrate is a substrate that produces a reaction with an enzyme.

A protein-nucleic acid may be attached to a solid support. The solid support, for example, is a surface. A surface can be an electrode. Sometimes the solid support is a bead. Often the bead is a magnetic bead. Upon cleavage, the protein is liberated from the solid and interacts with other mixtures. For example, the protein is an enzyme, and upon cleavage of the nucleic acid of the enzyme-nucleic acid, the enzyme flows through a chamber into a mixture comprising the substrate. When the enzyme meets the enzyme substrate, a reaction occurs, such as a colorimetric reaction, which is then detected. As another example, the protein is an enzyme substrate, and upon cleavage of the nucleic acid of the enzyme substrate-nucleic acid, the enzyme flows through a chamber into a mixture comprising the enzyme. When the enzyme substrate meets the enzyme, a reaction occurs, such as a calorimetric reaction, which is then detected.

Often, the signal is a colorimetric signal or a signal visible by eye. In some instances, the signal is fluorescent, electrical, chemical, electrochemical, or magnetic. A signal can be a calorimetric, potentiometric, amperometric, optical (e.g., fluorescent, colorimetric, etc.), or piezo-electric signal. In some cases, the detectable signal is a colorimetric signal or a signal visible by eye. In some instances, the detectable signal is fluorescent, electrical, chemical, electrochemical, or magnetic. In some cases, the first detection signal is generated by binding of the detection moiety to the capture molecule in the detection region, where the first detection signal indicates that the sample contained the target nucleic acid. Sometimes the system is capable of detecting more than one type of target nucleic acid, wherein the system comprises more than one type of guide nucleic acid and more than one type of nucleic acid of a reporter. In some cases, the detectable signal is generated directly by the cleavage event. Alternatively or in combination, the detectable signal is generated indirectly by the signal event. Sometimes the detectable signal is not a fluorescent signal. In some instances, the detectable signal is a colorimetric or color-based signal. In some cases, the detected target nucleic acid is identified based on its spatial location on the detection region of the support medium. In some cases, the second detectable signal is generated in a spatially distinct location than the first generated signal.

In some cases, the threshold of detection, for a subject method of detecting a single stranded target nucleic acid in a sample, is less than or equal to 10 nM. The term "threshold of detection" is used herein to describe the minimal amount of target nucleic acid that must be present in a sample in order for detection to occur. For example, when a threshold of detection is 10 nM, then a signal can be detected when a target nucleic acid is present in the sample at a concentration of 10 nM or more. In some cases, the threshold of detection is less than or equal to 5 nM, 1 nM, 0.5 nM, 0.1 nM, 0.05 nM, 0.01 nM, 0.005 nM, 0.001 nM, 0.0005 nM, 0.0001 nM, 0.00005 nM, 0.00001 nM, 10 pM, 1 pM, 500 fM, 250 fM, 100 fM, 50 fM, 10 fM, 5 fM, 1 fM, 500 attomole (aM), 100 aM, 50 aM, 10 aM, or 1 aM. In some cases, the threshold of detection is in a range of from 1 aM to 1 nM, 1 aM to 500 pM, 1 aM to 200 pM, 1 aM to 100 pM, 1 aM to 10 pM, 1 aM to 1 pM, 1 aM to 500 fM, 1 aM to 100 fM, 1 aM to 1 fM, 1 aM to 500 aM, 1 aM to 100 aM, 1 aM to 50 aM, 1 aM to 10 aM, 10 aM to 1 nM, 10 aM to 500 pM, 10 aM to 200 pM, 10 aM to 100 pM, 10 aM to 10 pM, 10 aM to 1 pM, 10 aM to 500 fM, 10 aM to 100 fM, 10 aM to 1 fM, 10 aM to 500 aM, 10 aM to 100 aM, 10 aM to 50 aM, 100 aM to 1 nM, 100 aM to 500 pM, 100 aM to 200 pM, 100 aM to 100 pM, 100 aM to 10 pM, 100 aM to 1 pM, 100 aM to 500 fM, 100 aM to 100 fM, 100 aM to 1 fM, 100 aM to 500 aM, 500 aM to 1 nM, 500 aM to 500 pM, 500 aM to 200 pM, 500 aM to 100 pM, 500 aM to 10 pM, 500 aM to 1 pM, 500 aM to 500 fM, 500 aM to 100 fM, 500 aM to 1 fM, 1 fM to 1 nM, 1 fM to 500 pM, 1 fM to 200 pM, 1 fM to 100 pM, 1 fM to 10 pM, 1 fM to 1 pM, 10 fM to 1 nM, 10 fM to 500 pM, 10 fM to 200 pM, 10 fM to 100 pM, 10 fM to 10 pM, 10 fM to 1 pM, 500 fM to 1 nM, 500 fM to 500 pM, 500 fM to 200 pM, 500 fM to 100 pM, 500 fM to 10 pM, 500 fM to 1 pM, 800 fM to 1 nM, 800 fM to 500 pM, 800 fM to 200 pM, 800 fM to 100 pM, 800 fM to 10 pM, 800 fM to 1 pM, from 1 pM to 1 nM, 1 pM to 500 pM, 1 pM to 200 pM, 1 pM to 100 pM, or 1 pM to 10 pM. In some cases, the threshold of detection in a range of from 800 fM to 100 pM, 1 pM to 10 pM, 10 fM to 500 fM, 10 fM to 50 fM, 50 fM to 100 fM, 100 fM to 250 fM, or 250 fM to 500 fM. In some cases the threshold of detection is in a range of from 2 aM to 100 pM, from 20 aM to 50 pM, from 50 aM to 20 pM, from 200 aM to 5 pM, or from 500 aM to 2 pM. In some cases, the minimum concentration at which a single stranded target nucleic acid is detected in a sample is in a range of from 1 aM to 1 nM, 10 aM to 1 nM, 100 aM to 1 nM, 500 aM to 1 nM, 1 fM to 1 nM, 1 fM to 500 pM, 1 fM to 200 pM, 1 fM to 100 pM, 1 fM to 10 pM, 1 fM to 1 pM, 10 fM to 1 nM, 10 fM to 500 pM, 10 fM to 200 pM, 10 fM to 100 pM, 10 fM to 10 pM, 10 fM to 1 pM, 500 fM to 1 nM, 500 fM to 500 pM, 500 fM to 200 pM, 500 fM to 100 pM, 500 fM to 10 pM, 500 fM to 1 pM, 800 fM to 1 nM, 800 fM to 500 pM, 800 fM to 200 pM, 800 fM to 100 pM, 800 fM to 10 pM, 800 fM to 1 pM, 1 pM to 1 nM, 1 pM to 500 pM, from 1 pM to 200 pM, 1 pM to 100 pM, or 1 pM to 10 pM. In some cases, the minimum concentration at which a single stranded target nucleic acid is detected in a sample is in a range of from 2 aM to 100 pM, from 20 aM to 50 pM, from 50 aM to 20 pM, from 200 aM to 5 pM, or from 500 aM to 2 pM. In some cases, the minimum concentration at which a single stranded target nucleic acid can be detected in a sample is in a range of from 1 aM to 100 pM. In some cases, the minimum concentration at which a single stranded target nucleic acid can be detected in a sample is in a range of from 1 fM to 100 pM. In some cases, the minimum concentration at which a single stranded target nucleic acid can be detected in a sample is in a range of from 10 fM to 100 pM. In some cases, the minimum concentration at which a single stranded target nucleic acid can be detected in a sample is in a range of from 800 fM to 100 pM. In some cases, the minimum concentration at which a single stranded target nucleic acid can be detected in a sample is in a range of from 1 pM to 10 pM. In some cases, the devices, systems, fluidic devices, kits, and methods described herein detect a target single-stranded nucleic acid in a sample comprising a plurality of nucleic acids such as a plurality of non-target nucleic acids, where the target single-stranded nucleic acid is present at a concentration as low as 1 aM, 10 aM, 100 aM, 500 aM, 1 fM, 10 fM, 500 fM, 800 fM, 1 pM, 10 pM, 100 pM, or 1 pM.

In some embodiments, the target nucleic acid is present in the cleavage reaction at a concentration of about 10 nM, about 20 nM, about 30 nM, about 40 nM, about 50 nM, about 60 nM, about 70 nM, about 80 nM, about 90 nM, about 100 nM, about 200 nM, about 300 nM, about 400 nM, about 500 nM, about 600 nM, about 700 nM, about 800 nM, about 900 nM, about 1 µM, about 10 µM, or about 100 µM. In some embodiments, the target nucleic acid is present in the cleavage reaction at a concentration of from 10 nM to 20 nM, from 20 nM to 30 nM, from 30 nM to 40 nM, from 40 nM to 50 nM, from 50 nM to 60 nM, from 60 nM to 70 nM, from 70 nM to 80 nM, from 80 nM to 90 nM, from 90 nM to 100 nM, from 100 nM to 200 nM, from 200 nM to 300 nM, from 300 nM to 400 nM, from 400 nM to 500 nM, from 500 nM to 600 nM, from 600 nM to 700 nM, from 700 nM to 800 nM, from 800 nM to 900 nM, from 900 nM to 1 µM, from 1 µM to 10 µM, from 10 µM to 100 µM, from 10 nM to 100 nM, from 10 nM to 1 µM, from 10 nM to 10 µM, from 10 nM to 100 µM, from 100 nM to 1 µM, from 100 nM to 10 µM, from 100 nM to 100 µM, or from 1 µM to 100 µM. In some embodiments, the target nucleic acid is present in the cleavage reaction at a concentration of from 20 nM to 50 µM, from 50 nM to 20 µM, or from 200 nM to 5 µM.

In some cases, the methods, compositions, reagents, enzymes, and kits described herein may be used to detect a target single-stranded nucleic acid in a sample where the sample is contacted with the reagents for a predetermined length of time sufficient for the trans cleavage to occur or cleavage reaction to reach completion. In some cases, the devices, systems, fluidic devices, kits, and methods described herein detect a target single-stranded nucleic acid in a sample where the sample is contacted with the reagents for no greater than 60 minutes. Sometimes the sample is contacted with the reagents for no greater than 120 minutes, 110 minutes, 100 minutes, 90 minutes, 80 minutes, 70 minutes, 60 minutes, 55 minutes, 50 minutes, 45 minutes, 40 minutes, 35 minutes, 30 minutes, 25 minutes, 20 minutes, 15 minutes, 10 minutes, 5 minutes, 4 minutes, 3 minutes, 2 minutes, or 1 minute. Sometimes the sample is contacted with the reagents for at least 120 minutes, 110 minutes, 100 minutes, 90 minutes, 80 minutes, 70 minutes, 60 minutes, 55 minutes, 50 minutes, 45 minutes, 40 minutes, 35 minutes, 30 minutes, 25 minutes, 20 minutes, 15 minutes, 10 minutes, or 5 minutes. In some cases, the sample is contacted with the reagents for from 5 minutes to 120 minutes, from 5 minutes to 100 minutes, from 10 minutes to 90 minutes, from 15 minutes to 45 minutes, or from 20 minutes to 35 minutes. In some cases, the devices, systems, fluidic devices, kits, and methods described herein can detect a target nucleic acid in a sample in less than 10 hours, less than 9 hours, less than 8 hours, less than 7 hours, less than 6 hours, less than 5 hours, less than 4 hours, less than 3 hours, less than 2 hours, less than 1 hour, less than 50 minutes, less than 45 minutes, less than 40 minutes, less than 35 minutes, less than 30 minutes, less than 25 minutes, less than 20 minutes, less than 15 minutes, less than 10 minutes, less than 9 minutes, less than 8 minutes, less than 7 minutes, less than 6 minutes, or less than 5 minutes. In some cases, the devices, systems, fluidic devices, kits, and methods described herein can detect a target nucleic acid in a sample in from 5 minutes to 10 hours, from 10 minutes to 8 hours, from 15 minutes to 6 hours, from 20 minutes to 5 hours, from 30 minutes to 2 hours, or from 45 minutes to 1 hour.

When a guide nucleic acid binds to a target nucleic acid, the programmable nuclease's trans cleavage activity can be initiated, and nucleic acids of a reporter can be cleaved, resulting in the detection of fluorescence. The guide nucleic acid may be a non-naturally occurring guide nucleic acid. A non-naturally occurring guide nucleic acid may comprise an engineered sequence having a repeat and a spacer that hybridizes to a target nucleic acid sequence of interest. A non-naturally occurring guide nucleic acid may be recombinantly expressed or chemically synthezised. Nucleic acid reporters can comprise a detection moiety, wherein the nucleic acid reporter can be cleaved by the activated programmable nuclease, thereby generating a signal. Some methods as described herein can a method of assaying for a target nucleic acid in a sample comprises contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal indicates an absence of the target nucleic acid in the sample. The cleaving of the nucleic acid of a reporter using the programmable nuclease may cleave with an efficiency of 50% as measured by a change in a signal that is calorimetric, potentiometric, amperometric, optical (e.g., fluorescent, colorimetric, etc.), or piezo-electric, as non-limiting examples. Some methods as described herein can be a method of detecting a target nucleic acid in a sample comprising contacting the sample comprising the target nucleic acid with a guide nucleic acid targeting a target nucleic acid segment, a programmable nuclease capable of being activated when complexed with the guide nucleic acid and the target nucleic acid segment, a single stranded nucleic acid of a reporter comprising a detection moiety, wherein the nucleic acid of a reporter is capable of being cleaved by the activated programmable nuclease, thereby generating a first detectable signal, cleaving the single stranded nucleic acid of a reporter using the programmable nuclease that cleaves as measured by a change in color, and measuring the first detectable signal on the support medium. The cleaving of the single stranded nucleic acid of a reporter using the programmable nuclease may cleave with an efficiency of 50% as measured by a change in color. In some cases, the cleavage efficiency is at least 40%, 50%, 60%, 70%, 80%, 90%, or 95% as measured by a change in color. The change in color may be a detectable colorimetric signal or a signal visible by eye. The change in color may be measured as a first detectable signal. The first detectable signal can be detectable within 5 minutes of contacting the sample comprising the target nucleic acid with a guide nucleic acid targeting a target nucleic acid segment, a programmable nuclease capable of being activated when complexed with the guide nucleic acid and the target nucleic acid segment, and a single stranded nucleic acid of a reporter comprising a detection moiety, wherein the nucleic acid of a reporter is capable of being cleaved by the activated nuclease. The first detectable signal can be detectable within 1, 2, 3, 4, 5, 6, 7, 8, 9, 10, 11, 12, 13, 14, 15, 20, 25, 30, 35, 40, 45, 50, 55, 60, 70, 80, 90, 100, 110, or 120 minutes of contacting the sample. In some embodiments, the first detectable signal can be detectable within from 1 to 120, from 5 to 100, from 10 to 90, from 15 to 80, from 20 to 60, or from 30 to 45 minutes of contacting the sample.

In some cases, the methods, reagents, enzymes, and kits described herein detect a target single-stranded nucleic acid with a programmable nuclease and a single-stranded nucleic acid of a reporter in a sample where the sample is contacted with the reagents for a predetermined length of time sufficient for trans cleavage of the single stranded nucleic acid of a reporter. In a preferred embodiment, a Cas13a programmable nuclease us used to detect the presence of a single-stranded DNA target nucleic acid. For example, a programmable nuclease is LbuCas13a that detects a target nucleic acid and a single stranded nucleic acid of a reporter comprises two adjacent uracil nucleotides with a green detectable moiety that is detected upon cleavage. As another example, a programmable nuclease is LbaCas13a that detects a target nucleic acid and a single-stranded nucleic acid of a reporter comprises two adjacent adenine nucleotides with a red detectable moiety that is detected upon cleavage.

Buffers

The reagents described herein can also include buffers, which are compatible with the methods, compositions, reagents, enzymes, and kits disclosed herein. Buffers can be referred to herein as a "high performance buffer" or an "activity buffer" and are compatible with different programmable nucleases described herein. Compositions including the high performance buffers and programmable nucleases described herein exhibit superior and efficient transcollateral cleavage activity in the various methods described herein (e.g., DETECTR assay methods for assaying for a target nucleic acid). Any of the methods, compositions, reagents, enzymes, or kits disclosed herein may comprise a buffer (e.g., a high performance buffer or an activity buffer). These buffers are compatible with the other reagents, samples, and support mediums as described herein for detection of an ailment, such as a disease, cancer, or genetic disorder, or genetic information, such as for phenotyping, genotyping, or determining ancestry. A buffer, as described herein, can enhance the assay detection a target nucleic acid, such as enhancing a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. The buffer can increase the discrimination of the programmable nuclease of the segment of the target nucleic acid and the at least one nucleic acid comprising at least 50% sequence identity to the segment of the target nucleic acid. For example, the buffer increases the discrimination between the segment of the target nucleic acid comprising a single nucleotide mutation and the at least one nucleic acid comprising a variant of the single nucleotide mutation of the segment of the target nucleic acid. Sometimes, the buffer increases the discrimination between the segment of the target nucleic acid comprising deletion and the at least one nucleic acid comprising a variant of the segment of the target nucleic acid. The methods as described herein can be performed in the buffer.

In some embodiments, a buffer may comprise one or more of a buffering agent, a salt, a crowding agent, or a detergent, or any combination thereof. A buffer may comprise a reducing agent. A buffer may comprise a competitor. Exemplary buffering agent include HEPES, Tris, and imidazole. A buffer may comprise HEPES, Tris, or any combination thereof. A buffer compatible with a programmable nuclease (e.g., SEQ ID NO: 11) may comprise HEPES. A buffer may comprise HEPES, Tris, or any combination thereof. A buffer compatible with a programmable nuclease (e.g., SEQ ID NO: 1) may comprise Tris. In some embodiments, a buffer compatible with a Cas12 programmable nuclease (e.g., SEQ ID NO: 11) comprises a buffering agent at a concentration of from 10 mM to 40 mM. In some embodiments, a buffer compatible with a Cas12 programmable nuclease (e.g., SEQ ID NO: 11) comprises a buffering agent at a concentration of about 20 mM. A buffer compatible with a programmable nuclease may comprise a buffering agent at a concentration of from 5 mM to 100 mM. A buffer compatible with a programmable nuclease may comprise a buffering agent at a concentration of from 10 mM to 30 mM. A composition (e.g., a composition comprising a programmable nuclease) may have a pH of from 7 to 8. A buffer compatible with a programmable nuclease (e.g., SEQ ID NO: 1 or SEQ ID NO: 11) may comprise a buffering agent at a concentration of from 1 mM to 50 mM. A buffer compatible with a programmable nuclease (e.g., SEQ ID NO: 1 or SEQ ID NO: 11) may comprise a buffering agent at a concentration of from 1 mM to 30 mM. A buffer compatible with a programmable nuclease (e.g., SEQ ID NO: 1 or SEQ ID NO: 11) may comprise a buffering agent at a concentration of about 20 mM.

Exemplary salts include NaCl, KCl, magnesium acetate, potassium acetate, and $MgCl_2$. A buffer may comprise potassium acetate, magnesium acetate, sodium chloride, magnesium chloride, or any combination thereof. In some embodiments, a buffer compatible with a Cas12 programmable nuclease (e.g., SEQ ID NO: 11) comprises a salt at a concentration of from 5 mM to 100 mM. In some embodiments, a buffer compatible with a Cas12 programmable nuclease (e.g., SEQ ID NO: 11) comprises a salt at a concentration of from 5 mM to 10 mM. A buffer compatible with a programmable nuclease may comprise a salt at a concentration of from 5 mM to 100 mM. A buffer compatible with a programmable nuclease may comprise a salt at a concentration of from 5 mM to 10 mM. In some embodiments, a buffer compatible with a programmable nuclease (e.g., SEQ ID NO: 11 or SEQ ID NO: 104) comprises a salt from 1 mM to 60 mM. In some embodiments, a buffer compatible with a programmable nuclease (e.g., SEQ ID NO: 11) comprises a salt from 1 mM to 10 mM. In some embodiments, a buffer compatible with a programmable nuclease (e.g., SEQ ID NO: 1) comprises a salt at about 105 mM. In some embodiments, a buffer compatible with a programmable nuclease (e.g., SEQ ID NO: 104) comprises a salt at about 55 mM. In some embodiments, a buffer compatible with a programmable nuclease (e.g., SEQ ID NO: 11) comprises a salt at about 7 mM. In some embodiments, a buffer compatible with a programmable nuclease (e.g., SEQ ID NO: 11) comprises a salt, wherein the salt comprises potassium acetate and magnesium acetate. In some embodiments, a buffer compatible with a programmable nuclease (e.g., SEQ ID NO: 1) comprises a salt, wherein the salt comprises sodium chloride and magnesium chloride. In some embodiments, a buffer compatible with a programmable nuclease (e.g., SEQ ID NO: 104) comprises a salt, wherein the salt comprises potassium chloride and magnesium chloride.

Exemplary crowding agents include glycerol and bovine serum albumin. A buffer may comprise glycerol. A crowding agent may reduce the volume of solvent available for other molecules in the solution, thereby increasing the effective concentrations of said molecules. In some embodiments, a buffer compatible with a Cas12 programmable nuclease (e.g., SEQ ID NO: 11) comprises a crowding agent at a concentration of from 0.5% (v/v) to 2% (v/v). In some embodiments, a buffer compatible with a Cas12 programmable nuclease (e.g., SEQ ID NO: 11) comprises a crowding agent at a concentration of about 1% (v/v). A buffer compatible with a programmable nuclease may comprise a crowding agent at a concentration of from 1% (v/v) to 5% (v/v). A buffer compatible with a programmable nuclease may comprise a crowding agent at a concentration of from 0.5% (v/v) to 10% (v/v).

Exemplary detergents include Tween, Triton-X, and IGEPAL. A buffer may comprise Tween, Triton-X, or any combination thereof. A buffer compatible with a programmable nuclease (e.g., SEQ ID NO: 11) may comprise Triton-X. A buffer compatible with a programmable nuclease (e.g., SEQ ID NO: 104) may comprise IGEPAL CA-630. In some embodiments, a buffer compatible with a programmable nuclease (e.g., SEQ ID NO: 11) comprises a detergent at a concentration of 2% (v/v) or less. In some embodiments, a buffer compatible with a programmable nuclease (e.g., SEQ ID NO: 11) comprises a detergent at a concentration of about 0.00016% (v/v). A buffer compatible with a programmable nuclease may comprise a detergent at a concentration of 2% (v/v) or less. A buffer compatible with a programmable nuclease (e.g., SEQ ID NO: 11 or SEQ ID NO: 104) may comprise a detergent at a concentration of from 0.00001% (v/v) to 0.01% (v/v). A buffer compatible with a programmable nuclease (e.g., SEQ ID NO: 104) may comprise a detergent at a concentration of about 0.01% (v/v).

Exemplary reducing agents comprise dithiothreitol (DTT), β-mercaptoethanol (BME), or tris(2-carboxyethyl) phosphine (TCEP). A buffer may comprise DTT. A buffer compatible with a programmable nuclease (e.g., SEQ ID NO: 1) may comprise DTT. A buffer compatible with a programmable nuclease may comprise a reducing agent at a concentration of from 0.01 mM to 100 mM. A buffer compatible with a programmable nuclease may comprise a reducing agent at a concentration of from 0.1 mM to 10 mM. A buffer compatible with a programmable nuclease may comprise a reducing agent at a concentration of from 0.5 mM to 2 mM. A buffer compatible with a programmable nuclease (e.g., SEQ ID NO: 1) may comprise a reducing agent at a concentration of from 0.01 mM to 100 mM. A buffer compatible with a programmable nuclease (e.g., SEQ ID NO: 1) may comprise a reducing agent at a concentration of from 0.1 mM to 10 mM. A buffer compatible with a programmable nuclease (e.g., SEQ ID NO: 1) may comprise a reducing agent at a concentration of about 1 mM.

A buffer compatible with a programmable nuclease may comprise a competitor. Exemplary competitors compete with the target nucleic acid or the detector nucleic acid for cleavage by the programmable nuclease. Exemplary competitors include heparin, and imidazole, and salmon sperm DNA. A buffer may comprise heparin. A buffer compatible with a programmable nuclease may comprise a competitor at a concentration of from 1 µg/mL to 100 µg/mL. A buffer compatible with a programmable nuclease may comprise a competitor at a concentration of from 40 µg/mL to 60 µg/mL.

In some embodiments, a buffer compatible with a programmable nuclease (e.g., SEQ ID NO: 1, SEQ ID NO: 11, or SEQ ID NO: 104) comprises a crowding agent or a competitor. For example, the crowding agent is present from 1% (v/v) to 10% (v/v). In some embodiments, the crowding agent or competitor is present from 1% (v/v) to 5% (v/v). In some embodiments, a buffer compatible with a programmable nuclease (e.g., SEQ ID NO: 1, or SEQ ID NO: 104) comprises a crowding agent or competitor present at about to 5% (v/v). In some embodiments, a buffer compatible with a programmable nuclease (e.g., SEQ ID NO: 11) comprises a crowding agent or competitor present at about 1% (v/v). In some embodiments, a buffer compatible with a programmable nuclease (e.g., SEQ ID NO: 1) comprises a crowding agent or competitor present from 1 µg/mL to 100 µg/mL. In some embodiments, a buffer compatible with a programmable nuclease (e.g., SEQ ID NO: 1) comprises a crowding agent or competitor present from 30 µg/mL to 70 µg/mL. In some embodiments, a buffer compatible with a programmable nuclease (e.g., SEQ ID NO: 1) comprises a crowding agent or competitor present at about 50 µg/mL. In some embodiments, a buffer compatible with a programmable nuclease (e.g., SEQ ID NO: 104) comprises a crowding agent or competitor present from 1 mM to 30 mM. In some embodiments, a buffer compatible with a programmable nuclease (e.g., SEQ ID NO: 104) comprises a crowding agent or competitor present from 1 mM to 50 mM. In some embodiments, a buffer compatible with a programmable nuclease (e.g., SEQ ID NO: 104) comprises a crowding agent or competitor present at about 20 mM. The crowding agent or competitor may be selected from the group consisting of: glycerol, heparin, bovine serum albumin, imidazole, and any combination thereof. In some embodiments, a buffer compatible with a programmable nuclease (e.g., SEQ ID NO: 11) comprises glycerol. In some embodiments, a buffer compatible with a programmable nuclease (e.g., SEQ ID NO: 1) comprises glycerol and heparin. In some embodiments, a buffer compatible with a programmable nuclease (e.g., SEQ ID NO: 104) comprises glycerol, BSA, and imidazole.

Sometimes, a method used herein comprises: contacting a programmable nuclease comprising a polypeptide having endonuclease activity and a guide nucleic acid to a target nucleic acid in a buffer comprising heparin. The heparin is present, for example, at a concentration of from 1 to 100 µg/ml heparin. Often, the heparin is present at a concentration of from 40 to 60 µg/ml heparin. Sometimes, the heparin is present at a concentration 50 µg/ml heparin. Often, the buffer comprises NaCl. The NaCl is present, for example, at a concentration of from 1 to 200 mM NaCl. Sometimes, the NaCl is present at a concentration of from 80 to 120 mM NaCl. Often, the NaCl is present at a concentration of 100 mM NaCl.

In some embodiments, the buffer comprises heparin. The buffer can comprise 50 µg/ml heparin. Sometimes, the buffer comprises 5 µg/ml, 10 µg/ml, 15 µg/ml, 20 µg/ml, 25 µg/ml, 30 µg/ml, 35 µg/ml, 40 µg/ml, 45 µg/ml, 50 µg/ml, 55 µg/ml, 60 µg/ml, 65 µg/ml, 70 µg/ml, 75 µg/ml, 80 µg/ml, 85 µg/ml, 90 µg/ml, 95 µg/ml, or 100 µg/ml of heparin, or any value within these values. Often, the buffer comprises from 40 µg/ml to 60 µg/ml heparin. Often, a buffer may comprise from 40 µg/ml to 60 µg/ml heparin. Preferably, a specificity buffer may comprise 50 µg/ml heparin. Preferrably, a high sensitivity buffer may not contain heparin.

In some embodiments, the buffer comprises NaCl. The buffer can comprise 100 mM NaCl. Sometimes, the buffer comprises 50 mM, 55 mM, 60 mM, 65 mM, 70 mM, 75 mM, 80 mM, 85 mM, 90 mM, 95 mM, 100 mM, 105 mM, 110 mM, 115 mM, 120 mM, 125 mM, 130 mM, 140 mM, 150 mM, or 200 mM of NaCl, or any value within these values. Often, the buffer comprises from 75 mM to 125 mM NaCl. Preferably, a high specificity buffer may comprise 100 mM NaCl. Preferably, a high sensitivity buffer may not contain NaCl.

In some embodiments, the buffer comprises heparin and NaCl. The buffer can comprise 50 µg/ml heparin and 100 mM NaCl. Sometimes, the buffer comprises 5 µg/ml, 10 µg/ml, 15 µg/ml, 20 µg/ml, 25 µg/ml, 30 µg/ml, 35 µg/ml, 40 µg/ml, 45 µg/ml, 50 µg/ml, 55 µg/ml, 60 µg/ml, 65 µg/ml, 70 µg/ml, 75 µg/ml, 80 µg/ml, 85 µg/ml, 90 µg/ml, 95 µg/ml, or 100 µg/ml of heparin, or any value within these values, and 50 mM, 55 mM, 60 mM, 65 mM, 70 mM, 75 mM, 80 mM, 85 mM, 90 mM, 95 mM, 100 mM, 105 mM, 110 mM, 115 mM, 120 mM, 125 mM, 130 mM, 140 mM, 150 mM, or 200 mM of NaCl, or any value within these values. Preferably, a high specificity buffer may comprise 100 mM NaCl and 50 µg/ml heparin. Preferably, a high sensitivity buffer may not contain NaCl and may not contain heparin.

A high specificity buffer can comprise 20 mM Tris pH 8.0, 100 mM NaCl, 5 mM MgCl$_2$, 1 mM DTT, 5% (v/v) glycerol, and 50 µg/ml heparin.

In contrast a high sensitivity buffer comprises the high specificity buffer as described above, but without the heparin and NaCl (e.g., 20 mM Tris pH 8.0, 5 mM MgCl$_2$, 1 mM DTT, 5% (v/v) glycerol).

Sometimes, a method used herein comprises: contacting a programmable nuclease comprising a polypeptide having endonuclease activity and a guide nucleic acid to a target nucleic acid in a buffer comprising heparin. The heparin is present, for example, at a concentration of from 1 to 100 µg/ml heparin. Often, the heparin is present at a concentration of from 40 to 60 µg/ml heparin. Sometimes, the heparin is present at a concentration 50 µg/ml heparin. Often, the buffer comprises NaCl. The NaCl is present, for example, at a concentration of from 1 to 200 mM NaCl. Sometimes, the NaCl is present at a concentration of from 80 to 120 mM NaCl. Often, the NaCl is present at a concentration of 100 mM NaCl.

As described herein, nucleic acid sequences comprising DNA may be detected using a DNA-activated programmable RNA nuclease and other reagents disclosed herein. Additionally, detection by a DNA-activated programmable RNA nuclease, which can cleave RNA reporters, allows for multiplexing with other programmable nucleases, such as a DNA-activated programmable DNA nuclease that can cleave DNA reporters (e.g., Type V CRISPR enzyme). The methods described herein can also include the use of buffers, which are compatible with the methods disclosed herein. For example, a buffer comprises 20 mM HEPES pH 6.8, 50 mM KCl, 5 mM MgCl$_2$, and 5% (v/v) glycerol. In some instances the buffer comprises from 0 to 100, 0 to 75, 0 to 50, 0 to 25, 0 to 20, 0 to 10.0 to 5, 5 to 10.5 to 15, 5 to 20, 5 to 25, to 30, 5 to 40, 5 to 50, 5 to 75, 5 to 100, 10 to 20, 10 to 30, 10 to 40, 10 to 50, 15 to 20, 15 to 25, 15 to 30, 15 to 4, 15 to 50, 20 to 25, 20 to 30, 20 to 40, or 20 to 50 mM HEPES pH 6.8. The buffer can comprise to 0 to 500, 0 to 400, 0 to 300, 0 to 250, 0 to 200, 0 to 150, 0 to 100, 0 to 75, 0 to 50, 0 to 25, 0 to 20, 0 to 10, 0 to 5, 5 to 10, 5 to 15, 5 to 20, 5 to 25, 5 to 30, 5 to 40, 5 to 50, 5 to 75, 5 to 100, 5 to 150, 5 to 200, 5 to 250, 5 to 300, 5 to 400, 5 to 500, 25 to 50, 25 to 75, 25 to 100, 50 to 100, 50 150, 50 to 200, 50 to 250, 50 to 300, 100 to 200, 100 to 250, 100 to 300, or 150 to 250 mM KCl. Preferably, a buffer may comprise 25 to 75 mM KCl. More preferably, a buffer may comprise 50 mM KCl. In other instances the buffer comprises 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 10 to 20, 10 to 30, 10 to 40, 10 to 50, 15 to 20, 15 to 25, 15 to 30, 15 to 4, 15 to 50, 20 to 25, 20 to 30, 20 to 40, or 20 to 50 mM MgCl$_2$. Preferably, a buffer may comprise 1 to 10 mM MgCl$_2$. More preferably, a buffer may comprise 5 mM MgCl$_2$. The buffer can comprise 0 to 25, 0 to 20, 0 to 10, 0 to 5, 5 to 10, 5 to 15, 5 to 20, 5 to 25, 5 to 30% (v/v) glycerol. The buffer can comprise 0 to 30, 2 to 25, or 10 to 20% (v/v) glycerol. Preferably, the buffer may comprise 0% (v/v) to 10% (v/v) glycerol. More preferably, a buffer may comprise 5% (v/v) glycerol. In an preferred example, a buffer may comprise 50 mM KCl, 5 mM MgCl$_2$, and 5% (v/v) glycerol.

In some embodiments, a buffer compatible with a Cas12 programmable nuclease (e.g., SEQ ID NO: 11) comprises a HEPES buffering agent. In some embodiments, a buffer compatible with a Cas12 programmable nuclease (e.g., SEQ ID NO: 11) comprises a salt, wherein the salt comprises potassium acetate, magnesium acetate, sodium chloride, magnesium chloride, potassium chloride, or any combination thereof. In some embodiments, a buffer compatible with a Cas12 programmable nuclease (e.g., SEQ ID NO: 11) comprises a glycerol crowding agent. In some embodiments, a buffer compatible with a Cas12 programmable nuclease (e.g., SEQ ID NO: 11) comprises a detergent, wherein the detergent is Tween, Triton-X, or any combination thereof. In some embodiments, a buffer compatible with a Cas12 programmable nuclease (e.g., SEQ ID NO: 11) comprises a pH of from 7 to 8. In some embodiments, a buffer compatible with a programmable nuclease (e.g., SEQ ID NO: 11 or SEQ ID NO: 104) comprises a pH of about 7.5. In some embodiments, a buffer compatible with a programmable nuclease (e.g., SEQ ID NO: 1) comprises a pH of about 8.

In some embodiments, a buffer compatible with a programmable nuclease may comprise a salt at less than about 110 mM and wherein the buffer comprises a pH of from 7 to 8. In some embodiments, the salt is from 1 mM to 110 mM. In some embodiments, a buffer compatible with a Cas12 programmable nuclease (e.g., SEQ ID NO: 11) comprises a pH of about 7.5. In some embodiments, a buffer (e.g., a buffer comprising about 20 mM HEPES, about 2 mM potassium acetate, about 5 mM magnesium acetate, about 1% (v/v) glycerol, about 0.00016% (v/v) Triton-X, and a pH of about 7.5) is compatible with a programmable nuclease comprising at least 60%, at least 70%, at least 80%, at least 85%, at least 90%, at least 92%, at least 95%, at least 97%, at least 99%, or 100% sequence identity to SEQ ID NO: 11. In some embodiments, a buffer (e.g., a buffer comprising about 20 mM Tris, about 100 mM sodium chloride, about 5 mM magnesium chloride, about 5% (v/v) glycerol, about 50 ug/mL heparin, about 1 mM DTT, and a pH of about 8) is compatible with a programmable nuclease comprising at least 60%, at least 70%, at least 80%, at least 85%, at least 90%, at least 92%, at least 95%, at least 97%, at least 99%, or 100% sequence identity to SEQ ID NO: 1. In some embodiments, a buffer (e.g., a buffer comprising about 50 mM potassium chloride, about 5 mM magnesium chloride, about 10 ug/ml bovine serum albumin, about 5% (v/v) glycerol, about 20 mM imidazole, about 0.01% (v/v) IGEPAL CA-630, and a pH of about 7.5) is compatible with a programmable nuclease comprising at least 60%, at least 70%, at least 80%, at least 85%, at least 90%, at least 92%, at least 95%, at least 97%, at least 99%, or 100% sequence identity to SEQ ID NO: 104. Any of the buffers or compositions described herein may comprise a guide nucleic acid (e.g., a non-naturally occurring guide nucleic acid). Any of the buffers or compositions described herein may comprise a detector nucleic acid.

As another example, a buffer comprises 100 mM Imidazole pH 7.5; 250 mM KCl, 25 mM $MgCl_2$, 50 pg/mL BSA, 0.05% (v/v) Igepal Ca-630, and 25% (v/v) Glycerol. In some instances the buffer comprises 0 to 500, 0 to 400, 0 to 300, 0 to 250, 0 to 200, 0 to 150, 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 5 to 150, 5 to 200, 5 to 250, 5 to 300, 5 to 400, 5 to 500, 25 to 50, 25 to 75, 25 to 100, 50 to 100, 50 150, 50 to 200, 50 to 250, 50 to 300, 100 to 200, 100 to 250, 100 to 300, or 150 to 250 mM Imidazole pH 7.5. In some instances, the buffer comprises 100 to 250, 100 to 200, or 150 to 200 mM Imidazole pH 7.5. Preferably, the buffer may comprise 20 mM Imidazole pH 7.5. The buffer can comprise 0 to 500, 0 to 400, 0 to 300, 0 to 250, 0 to 200, 0 to 150, 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 5 to 150, 5 to 200, 5 to 250, 5 to 300, 5 to 400, 5 to 500, 25 to 50, 25 to 75, 25 to 100, 50 to 100, 50 150, 50 to 200, 50 to 250, 50 to 300, 100 to 200, 100 to 250, 100 to 300, or 150 to 250 mM KCl. Preferably, a buffer may comprise 25 to 75 mM KCl. More preferably, a buffer may comprise 50 mM KCl. In other instances the buffer comprises 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 10 to 20, 10 to 30, 10 to 40, 10 to 50, 15 to 20, 15 to 25, 15 to 30, 15 to 4, 15 to 50, 20 to 25, 20 to 30, 20 to 40, or 20 to 50 mM $MgCl_2$. Preferably, a buffer may comprise 1 to 10 mM $MgCl_2$. More preferably, a buffer may comprise 5 mM $MgCl_2$. The buffer, in some instances, comprises 0 to 100, 0 to 75, 0 to 50, 0 to 25, 0 to 20, 0 to 10, 0 to 5, 5 to 50, 5 to 75, 5 to 100, 10 to 20, 10 to 50, 10 to 75, 10 to 100, 25 to 50, 25 to 75 25 to 100, 50 to 75, or 50 to 100 pg/mL BSA. In some instances, the buffer comprises 0 to 1, 0 to 0.5, 0 to 0.25, 0 to 0.01, 0 to 0.05, 0 to 0.025, 0 to 0.01, 0.01 to 0.025, 0.01 to 0.05, 0.01 to 0.1, 0.01 to 0.25, 0.01, to 0.5, 0.01 to 1, 0.025 to 0.05, 0.025 to 0.1, 0.025, to 0.5, 0.025 to 1, 0.05 to 0.1, 0.05 to 0.25, 0.05 to 0.5, 0.05 to 0.75, 0.05 to 1, 0.1 to 0.25, 0.1 to 0.5, or 0.1 to 1% (v/v) Igepal Ca-630. The buffer can comprise 0 to 25, 0 to 20, 0 to 10, 0 to 5, 5 to 10, 5 to 15, 5 to 20, 5 to 25, 5 to 30% (v/v) glycerol. The buffer can comprise 0 to 30, 2 to 25, or 10 to 20% (v/v) glycerol. Preferably, the buffer may comprise 0% (v/v) to 10% (v/v) glycerol. More preferably, a buffer may comprise 5% (v/v) glycerol. While reagent (e.g., crowding agents or detergents) concentrations may be described in terms of percent volume per volume (v/v), a percent may also indicate percent weight per volume (w/v).

Stability

Present in this disclosure are stable compositions of the reagents and the programmable nuclease system for use in the methods as discussed herein. The reagents and programmable nuclease system described herein may be stable in various storage conditions including refrigerated, ambient, and accelerated conditions. Disclosed herein are stable reagents. The stability may be measured for the reagents and programmable nuclease system themselves or the reagents and programmable nuclease system present on the support medium.

In some instances, stable as used herein refers to a reagents having about 5% w/w or less total impurities at the end of a given storage period. Stability may be assessed by HPLC or any other known testing method. The stable reagents may have about 10% w/w, about 5% w/w, about 4% w/w, about 3% w/w, about 2% w/w, about 1% w/w, or about 0.5% w/w total impurities at the end of a given storage period. The stable reagents may have from 0.5% w/w to 10% w/w, from 1% w/w to 8% w/w, from 2% w/w to 7% w/w, or from 3% w/w to 5% w/w total impurities at the end of a given storage period.

In some embodiments, stable as used herein refers to a reagents and programmable nuclease system having about 10% or less loss of detection activity at the end of a given storage period and at a given storage condition. Detection activity can be assessed by known positive sample using a known method. Alternatively or combination, detection activity can be assessed by the sensitivity, accuracy, or specificity. In some embodiments, the stable reagents has about 10%, about 9%, about 8%, about 7%, about 6%, about 5%, about 4%, about 3%, about 2%, about 1%, or about 0.5% loss of detection activity at the end of a given storage period. In some embodiments, the stable reagents has from 0.5% to 10%, from 1% to 8%, from 2% to 7%, or from 3% to 5% loss of detection activity at the end of a given storage period.

In some embodiments, the stable composition has zero loss of detection activity at the end of a given storage period and at a given storage condition. The given storage condition may comprise humidity of equal to or less than 10%, 20%, 30%, 40%, 50%, 60%, 70%, 80%, 90%, or 100% relative humidity. The controlled storage environment may comprise humidity from 0% to 50% relative humidity, from 0% to 40% relative humidity, from 0% to 30% relative humidity, from 0% to 20% relative humidity, or from 0% to 10% relative humidity. The controlled storage environment may comprise humidity from 10% to 80%, from 10% to 70%, from 10% to 60%, from 20% to 50%, from 20% to 40%, or from 20% to 30% relative humidity. The controlled storage environment may comprise temperatures of about −100° C., about −80° C., about −20° C., about 4° C., about 25° C. (room temperature), or about 40° C. The controlled storage environment may comprise temperatures from −80° C. to 25° C., or from −100° C. to 40° C. The controlled storage environment may comprise temperatures from −20° C. to 40° C., from −20° C. to 4° C., or from 4° C. to 40° C. The controlled storage environment may protect the system or kit from light or from mechanical damage. The controlled storage environment may be sterile or aseptic or maintain the sterility of the light conduit. The controlled storage environment may be aseptic or sterile.

A kit of this disclosure can be packaged to be stored for extended periods of time prior to use. The kit or system may be packaged to avoid degradation of the kit or system. The packaging may include desiccants or other agents to control the humidity within the packaging. The packaging may protect the kit or system from mechanical damage or thermal damage. The packaging may protect the kit or system from contamination of the reagents and programmable nuclease system. The kit or system may be transported under conditions similar to the storage conditions that result in high stability of the reagent or little loss of reagent activity. The packaging may be configured to provide and maintain sterility of the kit. The kit can be compatible with standard manufacturing and shipping operations.

Multiplexing

The compositions and methods disclosed herein can be carried out for multiplexed detection. The compositions and methods for multiplexed detection are compatible with the DETECTR assay methods disclosed herein. The compositions and methods for multiplexed detection described here are compatible with any of the programmable nucleases disclosed herein (e.g., a programmable nuclease with at least 60% sequence identity to SEQ ID NO: 11) and use of said programmable nuclease in a method of detecting a target nucleic acid. The compositions and methods for multiplexed detection described here are compatible with any of the compositions comprising a programmable nuclease and a buffer, which has been developed to improve the function of the programmable nuclease (e.g., a programmable nuclease and a buffer with low salt (about 110 mM or less) and a pH of 7 to 8) and use of said compositions in a method of detecting a target nucleic acid. The compositions and methods for multiplexed detection described here are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence. These methods of multiplexing are, for example, consistent with fluidic devices for detection of a target nucleic acid sequence within the sample, wherein the fluidic device may comprise multiple pumps, valves, reservoirs, and chambers for sample preparation, amplification of a target nucleic acid sequence within the sample, mixing with a programmable nuclease, and detection of a detectable signal arising from cleavage of the nucleic acids of a reporter by the programmable nuclease within the fluidic system itself.

The methods described herein can be multiplexed in a number of ways. These methods of multiplexing are, for example, consistent with the assay methods disclosed herein for detection of a target nucleic acid within the sample when the target nucleic acid, such as multiplexing a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. The guide nucleic acid may be a non-naturally occurring guide nucleic acid. A non-naturally occurring guide nucleic acid may comprise an engineered sequence having a repeat and a spacer that hybridizes to a target nucleic acid sequence of interest. A non-naturally occurring guide nucleic acid may be recombinantly expressed or chemically synthezised.

In some embodiments, the target nucleic acid for multiplexed detection lacks a PAM. A method of multiplexed assaying for a target nucleic acid segment in a sample, wherein the target nucleic acid segment lacks a PAM sequence, may comprise amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample.

Methods consistent with the present disclosure include a multiplexing method of assaying for a target nucleic acid in a sample. A multiplexing method comprises contacting the sample to a complex comprising a guide nucleic acid comprising a segment that is reverse complementary to a segment of the target nucleic acid (e.g., DNA) and a programmable nuclease (e.g., a DNA-activated programmable RNA nuclease, such as Cas13) that exhibits sequence-independent cleavage upon forming a complex comprising the segment of the guide nucleic acid binding to the target nucleic acid; and assaying for a signal indicating cleavage of at least some protein-nucleic acids of a population of protein-nucleic acids, wherein the signal indicates a presence of the target nucleic acid in the sample and wherein absence of the signal indicates an absence of the target nucleic acid in the sample. As another example, multiplexing method of assaying for a target nucleic acid in a sample, for example, comprises: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal indicates an absence of the target nucleic acid in the sample. Often, the substrate is an enzyme-nucleic acid. Sometimes, the substrate is an enzyme substrate-nucleic acid.

Multiplexing can be either spatial multiplexing wherein multiple different target nucleic acids at the same time, but the reactions are spatially separated. Often, the multiple target nucleic acids are detected using the same programmable nuclease, but different guide nucleic acids. The multiple target nucleic acids sometimes are detected using the different programmable nucleases. For example, a DNA-activated programmable RNA nuclease and a DNA-activated programmable DNA nuclease can both be used in a single assay to directly detect DNA targets encoding different sequences. The activated DNA-activated programmable RNA nuclease cleaves an RNA reporter, generating a first detectable signal and the activated DNA-activated programmable DNA nuclease cleaves a DNA reporter, generating a second detectable signal. In some embodiments, the first and second detectable signals are different, and those allow simultaneous detection of more than one target DNA sequences using two programmable nucleases. In some embodiments, the DNA-activated programmable DNA nuclease and the DNA-activated programmable RNA nuclease are complexed to a guide nucleic acid that hybridizes to the same target DNA. The activated DNA-activated programmable RNA nuclease cleaves an RNA reporter, generating a first detectable signal and the DNA-activated programmable DNA nuclease cleaves a DNA reporter, generating a second detectable signal. The first detectable signal and the second detectable signal can be the same, thus, allowing for signal amplification by cleavage of reporters by two different programmable nucleases that are activated by the same target DNA.

Sometimes, multiplexing can be single reaction multiplexing wherein multiple different target nucleic acids are detected in a single reaction volume. Often, at least two different programmable nucleases are used in single reaction multiplexing. For example, multiplexing can be enabled by immobilization of multiple categories of nucleic acids of a reporter within a fluidic system, to enable detection of multiple target nucleic acids within a single fluidic system. Multiplexing allows for detection of multiple target nucleic acids in one kit or system. In some cases, the multiple target nucleic acids comprise different target nucleic acids to a virus, a bacterium, or a pathogen responsible for one disease. In some cases, the multiple target nucleic acids comprise different target nucleic acids associated with a cancer or genetic disorder. Multiplexing for one disease, cancer, or genetic disorder increases at least one of sensitivity, specificity, or accuracy of the assay to detect the presence of the disease in the sample. In some cases, the multiple target nucleic acids comprise target nucleic acids directed to different viruses, bacteria, or pathogens responsible for more than one disease. In some cases, multiplexing allows for discrimination between multiple target nucleic acids, such as target nucleic acids that comprise different genotypes of the same bacteria or pathogen responsible for a disease, for example, for a wild-type genotype of a bacteria or pathogen and for genotype of a bacteria or pathogen comprising a mutation, such as a single nucleotide polymorphism (SNP) or deletion that can confer resistance to a treatment, such as antibiotic treatment. For example, multiplexing comprises method of assaying comprising a single assay for a microorganism species using a first programmable nuclease and an antibiotic resistance pattern in a microorganism using a second programmable nuclease. Sometimes, multiplexing allows for discrimination between multiple target nucleic acids of different HPV strains, for example, HPV16 and HPV18. In some cases, the multiple target nucleic acids comprise target nucleic acids directed to different cancers or genetic disorders. Often, multiplexing allows for discrimination between multiple target nucleic acids, such as target nucleic acids that comprise different genotypes, for example, for a wild-type genotype and for SNP genotype. Multiplexing for multiple diseases, cancers, or genetic disorders provides the capability to test a panel of diseases from a single sample. For example, multiplexing for multiple diseases can be valuable in a broad panel testing of a new patient or in epidemiological surveys. Often multiplexing is used for identifying bacterial pathogens in sepsis or other diseases associated with multiple pathogens.

Furthermore, signals from multiplexing can be quantified. For example, a method of quantification for a disease panel comprises assaying for a plurality of unique target nucleic acids in a plurality of aliquots from a sample, assaying for a control nucleic acid control in a second aliquot of the sample, and quantifying a plurality of signals of the plurality of unique target nucleic acids by measuring signals produced by cleavage of nucleic acids of a reporter compared to the signal produced in the second aliquot. Often the plurality of unique target nucleic acids are from a plurality of bacterial pathogens in the sample. Sometimes the quantification of a signal of the plurality correlates with a concentration of a unique target nucleic acid of the plurality for the unique target nucleic acid of the plurality that produced the signal of the plurality. The disease panel can be for any communicable disease, such as sepsis.

The methods described herein can be multiplexed by various configurations of the reagents and the support medium. In some cases, the kit or system is designed to have multiple support mediums encased in a single housing. Sometimes, the multiple support mediums housed in a single housing share a single sample pad. The single sample pad may be connected to the support mediums in various designs such as a branching or a radial formation. Alternatively, each of the multiple support mediums has its own sample pad. In some cases, the kit or system is designed to have a single support medium encased in a housing, where the support medium comprises multiple detection spots for detecting multiple target nucleic acids. Sometimes, the reagents for multiplexed assays comprise multiple guide nucleic acids, multiple programmable nucleases, and multiple single stranded detector nucleic acids, where a combination of one of the guide nucleic acids, one of the programmable nucleases, and one of the single stranded detector nucleic acids detects one target nucleic acid and can provide a detection spot on the detection region. In some cases, the combination of a guide nucleic acid, a programmable nuclease, and a single stranded detector nucleic acid configured to detect one target nucleic acid is mixed with at least one other combination in a single reagent chamber. In some cases, the combination of a guide nucleic acid, a programmable nuclease, and a single stranded detector nucleic acid configured to detect one target nucleic acid is mixed with at least one other combination on a single support medium. When these combinations of reagents are contacted with the sample, the reaction for the multiple target nucleic acids occurs simultaneously in the same medium or reagent chamber. Sometimes, this reacted sample is applied to the multiplexed support medium described herein.

In some cases, the combination of a guide nucleic acid, a programmable nuclease, and a single stranded detector nucleic acid configured to detect one target nucleic acid is provided in its own reagent chamber or its own support medium. In this case, multiple reagent chambers or support mediums are provided in the device, kit, or system, where one reagent chamber is designed to detect one target nucleic acid. In this case, multiple support mediums are used to detect the panel of diseases, cancers, or genetic disorders of interest.

In some instances, multiplexed detection detects at least 2 different target nucleic acids in a single reaction. In some instances, multiplexed detection detects at least 3 different target nucleic acids in a single reaction. In some instances, multiplexed detection detects at least 4 different target nucleic acids in a single reaction. In some instances, multiplexed detection detects at least 5 different target nucleic acids in a single reaction. In some cases, multiplexed detection detects at least 6, 7, 8, 9, or 10 different target nucleic acids in a single reaction. In some instances, the multiplexed kits detect at least 2 different target nucleic acids in a single kit. In some instances, the multiplexed kits detect at least 3 different target nucleic acids in a single kit. In some instances, the multiplexed kits detect at least 4 different target nucleic acids in a single kit. In some instances, the multiplexed kits detect at least 5 different target nucleic acids in a single kit. In some instances, the multiplexed kits detect at least 6, 7, 8, 9, or 10 different target nucleic acids in a single kit. In some instances, the multiplexed kits detect from 2 to 10, from 3 to 9, from 4 to 8, or from 5 to 7 different target nucleic acids in a single kit.

Detection Methods

Disclosed herein are methods of assaying for a target nucleic acid as described herein wherein a signal is detected. The methods of assaying for a target nucleic acid wherein a signal is detected are compatible with the DETECTR assay methods disclosed herein. The methods of assaying for a target nucleic acid wherein a signal is detected, as described herein, are compatible with any of the programmable nucleases disclosed herein (e.g., a programmable nuclease with at least 60% sequence identity to SEQ ID NO: 11) and use of said programmable nuclease in a method of detecting a target nucleic acid. The methods of assaying for a target nucleic acid wherein a signal is detected, as described herein, are compatible with any of the compositions comprising a programmable nuclease and a buffer, which has been developed to improve the function of the programmable nuclease (e.g., a programmable nuclease and a buffer with low salt (about 110 mM or less) and a pH of 7 to 8) and use of said compositions in a method of detecting a target nucleic acid. The methods of assaying for a target nucleic acid wherein a signal is detected, as described herein, are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence. A method of assaying for a segment of a target nucleic acid in a sample may comprise contacting the sample to a detector nucleic acid any of the compositions described herein (e.g., a composition comprising a programmable nuclease of SEQ ID NO: 11), wherein the guide nucleic acid hybridizes to a segment of the target nucleic acid, and assaying for a signal produced by cleavage of the detector nucleic acid. In some embodiments, the programmable nuclease (e.g., a Cas12 programmable nuclease) cleaves the detector nucleic acid upon hybridization of the guide nucleic acid to the segment of the target nucleic acid. In some embodiments, the signal produced by cleavage of the detector nucleic acid may be at least two-fold greater when the segment of the target nucleic acid is present in the sample than the signal when the sample lacks the segment of the target nucleic acid and wherein the subject has a disease when the segment of the target nucleic acid is present.

In some embodiments, the methods disclosed herein are methods of assaying for a target deoxyribonucleic acid as described herein using a DNA-activated programmable RNA nuclease wherein a signal is detected. For example, a method of assaying for a target nucleic acid in a sample comprises contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal indicates an absence of the target nucleic acid in the sample. In some embodiments, the sample comprises at least one nucleic acid comprising at least 50% sequence identity to a segment of the target nucleic acid. As another example, a method of assaying for a target nucleic acid in a sample, for example, comprises: a) contacting the sample to a complex comprising a guide nucleic acid comprising a segment that is reverse complementary to a segment of the target nucleic acid and a DNA-activated programmable RNA nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal indicates an absence of the target nucleic acid in the sample. Often, the substrate is an enzyme-nucleic acid. Sometimes, the substrate is an enzyme substrate-nucleic acid. As described herein, nucleic acid sequences comprising DNA may be detected using a DNA-activated programmable RNA nuclease and other reagents disclosed herein.

In some embodiments, a method of assaying for a target nucleic acid in a sample comprises a sample, wherein the target nucleic acid segment lacks a PAM. For example, a method of assaying for a target nucleic acid segment in a sample, wherein the target nucleic acid segment lacks a PAM sequence, comprises amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample. A PAM-dependent sequence specific nuclease, often, is a programmable nuclease. Sometimes, a PAM-dependent sequence specific nuclease is a PAM-dependent sequence specific endonuclease.

Present in this disclosure are methods of assaying for a target nucleic acid as described herein. In some embodiments, the method is a method of assaying for a target deoxyribonucleic acid using a DNA-activated programmable RNA nuclease, wherein assaying comprises detecting cleavage of an RNA reporter. For example, a method of assaying for a target nucleic acid in a sample comprises contacting the sample to a complex comprising a guide nucleic acid comprising a segment that is reverse complementary to a segment of the target nucleic acid and a programmable nuclease (e.g., a DNA-activated programmable RNA nuclease) that exhibits sequence independent cleavage upon forming a complex comprising the segment of the guide nucleic acid binding to the segment of the target nucleic acid (e.g. target deoxyribonucleic acid); and assaying for a signal indicating cleavage of at least some protein-nucleic acids of a population of protein-nucleic acids, wherein the signal indicates a presence of the target nucleic acid in the sample and wherein absence of the signal indicates an absence of the target nucleic acid in the sample. As another example, a method of assaying for a target nucleic acid in a sample, for example, comprises: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal indicates an absence of the target nucleic acid in the sample. Often, the substrate is an enzyme-nucleic acid. Sometimes, the substrate is an enzyme substrate-nucleic acid.

A programmable nuclease can comprise a programmable nuclease capable of being activated when complexed with a guide nucleic acid and target nucleic acid. The programmable nuclease can become activated after binding of a guide nucleic acid with a target nucleic acid, in which the activated programmable nuclease can cleave the target nucleic acid and can have trans cleavage activity. Trans cleavage activity can be non-specific cleavage of nearby nucleic acids by the activated programmable nuclease, such as trans cleavage of detector nucleic acids with a detection moiety. Once the detector nucleic acid is cleaved by the activated programmable nuclease, the detection moiety can be released from the detector nucleic acid and can generate a signal. The signal can be immobilized on a support medium for detection. The signal can be visualized to assess whether a target nucleic acid comprises a modification.

Often, the signal is a colorimetric signal or a signal visible by eye. In some instances, the signal is fluorescent, electrical, chemical, electrochemical, or magnetic. In some cases, the signal is generated by binding of the detection moiety to the capture molecule in the detection region, where the signal indicates that the sample contained the target nucleic acid. Sometimes the system is capable of detecting more than one type of target nucleic acid, wherein the system comprises more than one type of guide nucleic acid and more than one type of detector nucleic acid. In some cases, the signal is generated directly by the cleavage event. Alternatively, or in combination, the signal is generated indirectly by the signal event. Sometimes the signal is not a fluorescent signal. In some instances, the signal is a colorimetric or color-based signal. In some cases, the detected target nucleic acid is identified based on its spatial location on the detection region of the support medium. In some cases, the second detectable signal is generated in a spatially distinct location than the first generated signal.

In some cases, the threshold of detection, for a method of assaying of a target nucleic acid described herein in a sample, is less than or equal to 10 nM. The term "threshold of detection" is used herein to describe the minimal amount of target nucleic acid that must be present in a sample in order for detection to occur. For example, when a threshold of detection is 10 nM, then a signal can be detected when a target nucleic acid is present in the sample at a concentration of 10 nM or more. In some cases, the threshold of detection is less than or equal to 5 nM, 1 nM, 0.5 nM, 0.1 nM, 0.05 nM, 0.01 nM, 0.005 nM, 0.001 nM, 0.0005 nM, 0.0001 nM, 0.00005 nM, 0.00001 nM, 10 pM, 1 pM, 500 fM, 250 fM, 100 fM, 50 fM, 10 fM, 5 fM, 1 fM, 500 attomole (aM), 100 aM, 50 aM, 10 aM, or 1 aM. In some cases, the threshold of detection is in a range of from 1 aM to 1 nM, 1 aM to 500 pM, 1 aM to 200 pM, 1 aM to 100 pM, 1 aM to 10 pM, 1 aM to 1 pM, 1 aM to 500 fM, 1 aM to 100 fM, 1 aM to 1 fM, 1 aM to 500 aM, 1 aM to 100 aM, 1 aM to 50 aM, 1 aM to 10 aM, 10 aM to 1 nM, 10 aM to 500 pM, 10 aM to 200 pM, 10 aM to 100 pM, 10 aM to 10 pM, 10 aM to 1 pM, 10 aM to 500 fM, 10 aM to 100 fM, 10 aM to 1 fM, 10 aM to 500 aM, 10 aM to 100 aM, 10 aM to 50 aM, 100 aM to 1 nM, 100 aM to 500 pM, 100 aM to 200 pM, 100 aM to 100 pM, 100 aM to 10 pM, 100 aM to 1 pM, 100 aM to 500 fM, 100 aM to 100 fM, 100 aM to 1 fM, 100 aM to 500 aM, 500 aM to 1 nM, 500 aM to 500 pM, 500 aM to 200 pM, 500 aM to 100 pM, 500 aM to 10 pM, 500 aM to 1 pM, 500 aM to 500 fM, 500 aM to 100 fM, 500 aM to 1 fM, 1 fM to 1 nM, 1 fM to 500 pM, 1 fM to 200 pM, 1 fM to 100 pM, 1 fM to 10 pM, 1 fM to 1 pM, 10 fM to 1 nM, 10 fM to 500 pM, 10 fM to 200 pM, 10 fM to 100 pM, 10 fM to 10 pM, 10 fM to 1 pM, 500 fM to 1 nM, 500 fM to 500 pM, 500 fM to 200 pM, 500 fM to 100 pM, 500 fM to 10 pM, 500 fM to 1 pM, 800 fM to 1 nM, 800 fM to 500 pM, 800 fM to 200 pM, 800 fM to 100 pM, 800 fM to 10 pM, 800 fM to 1 pM, fom 1 pM to 1 nM, 1 pM to 500 pM, 1 pM to 200 pM, 1 pM to 100 pM, or 1 pM to 10 pM. In some cases, the threshold of detection in a range of from 800 fM to 100 pM, 1 pM to 10 pM, 10 fM to 500 fM, 10 fM to 50 fM, 50 fM to 100 fM, 100 fM to 250 fM, or 250 fM to 500 fM. In some cases, the minimum concentration at which a target nucleic acid is detected in a sample is in a range of from 1 aM to 1 nM, 10 aM to 1 nM, 100 aM to 1 nM, 500 aM to 1 nM, 1 fM to 1 nM, 1 fM to 500 pM, 1 fM to 200 pM, 1 fM to 100 pM, 1 fM to 10 pM, 1 fM to 1 pM, 10 fM to 1 nM, 10 fM to 500 pM, 10 fM to 200 pM, 10 fM to 100 pM, 10 fM to 10 pM, 10 fM to 1 pM, 500 fM to 1 nM, 500 fM to 500 pM, 500 fM to 200 pM, 500 fM to 100 pM, 500 fM to 10 pM, 500 fM to 1 pM, 800 fM to 1 nM, 800 fM to 500 pM, 800 fM to 200 pM, 800 fM to 100 pM, 800 fM to 10 pM, 800 fM to 1 pM, 1 pM to 1 nM, 1 pM to 500 pM, from 1 pM to 200 pM, 1 pM to 100 pM, or 1 pM to 10 pM. In some cases, the minimum concentration at which a target nucleic acid can be detected in a sample is in a range of from 1 aM to 100 pM. In some cases, the minimum concentration at which a target nucleic acid can be detected in a sample is in a range of from 1 fM to 100 pM. In some cases, the minimum concentration at which a target nucleic acid can be detected in a sample is in a range of from 10 fM to 100 pM. In some cases, the minimum concentration at which a target nucleic acid can be detected in a sample is in a range of from 800 fM to 100 pM. In some cases, the minimum concentration at which a target nucleic acid can be detected in a sample is in a range of from 1 pM to 10 pM. In some cases, methods described herein detect a target nucleic acid in a sample comprising a plurality of nucleic acids such as a plurality of non-target nucleic acids, where the nucleic acid is present at a concentration as low as 1 aM, 10 aM, 100 aM, 500 aM, 1 fM, 10 fM, 500 fM, 800 fM, 1 pM, 10 pM, 100 pM, or 1 pM.

In some cases, the methods described herein detect a target nucleic acid in a sample where the sample is contacted with the reagents for a predetermined length of time sufficient for the trans cleavage to occur or cleavage reaction to reach completion. In some cases, the methods described herein detect a target nucleic acid in a sample where the sample is contacted with the reagents for no greater than 60 minutes. Sometimes the sample is contacted with the reagents for no greater than 120 minutes, 110 minutes, 100 minutes, 90 minutes, 80 minutes, 70 minutes, 60 minutes, 55 minutes, 50 minutes, 45 minutes, 40 minutes, 35 minutes, 30 minutes, 25 minutes, 20 minutes, 15 minutes, 10 minutes, 5 minutes, 4 minutes, 3 minutes, 2 minutes, or 1 minute. Sometimes the sample is contacted with the reagents for at least 120 minutes, 110 minutes, 100 minutes, 90 minutes, 80 minutes, 70 minutes, 60 minutes, 55 minutes, 50 minutes, 45 minutes, 40 minutes, 35 minutes, 30 minutes, 25 minutes, 20 minutes, 15 minutes, 10 minutes, or 5 minutes.

Some methods as described herein can be a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. Some methods as described herein can be a method of assaying for a target nucleic acid in a sample comprising: producing a PAM target nucleic acid comprising a sequence encoding a PAM by amplifying the target nucleic acid of the sample using primers comprising the encoding the PAM; contacting the PAM target nucleic acid to a complex comprising a guide nucleic acid comprising a segment that is reverse complementary to a segment of the PAM target nucleic acid and a programmable nuclease that exhibits sequence independent cleavage upon forming a complex comprising the segment of the guide nucleic acid binding to the segment of the PAM target nucleic acid; and assaying for a signal indicating cleavage of at least some detector nucleic acids of a population of detector nucleic acids, wherein the signal indicates a presence of the target nucleic acid in the sample and wherein the absence of the signal indicates an absence of the target nucleic acid in the sample. The cleaving of the detector nucleic acid using the programmable nuclease may cleave with an efficiency of 50% as measured by a change in a signal that is calorimetric, potentiometric, amperometric, optical (e.g., fluorescent, colorimetric, etc.), or piezo-electric, as non-limiting examples. In some cases, the cleavage efficiency is at least 40%, 50%, 60%, 70%, 80%, 90%, or 95% as measured by a change in a signal that is calorimetric, potentiometric, amperometric, optical (e.g., fluorescent, colorimetric, etc.), or piezo-electric, as non-limiting examples. The change in color may be a detectable colorimetric signal or a signal visible by eye. The signal can be detectable within 5 minutes of contacting the sample comprising the target nucleic acid to a guide nucleic acid complexed with programmable nuclease and a detector nucleic acid comprising a detection moiety, wherein the nucleic acid of the detector nucleic is cleaved by the activated nuclease. The signal can be detectable within 1, 2, 3, 4, 5, 6, 7, 8, 9, 10, 11, 12, 13, 14, 15, 20, 25, 30, 35, 40, 45, 50, 55, 60, 70, 80, 90, 100, 110, or 120 minutes of contacting the sample.

The methods described herein can also include the use of buffers, which are compatible with the methods disclosed herein. For example, a buffer comprises 20 mM HEPES pH 6.8, 50 mM KCl, 5 mM $MgCl_2$, and 5% glycerol. In some instances the buffer comprises from 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 10 to 20, 10 to 30, 10 to 40, 10 to 50, 15 to 20, 15 to 25, 15 to 30, 15 to 4, 15 to 50, 20 to 25, 20 to 30, 20 to 40, or 20 to 50 mM HEPES pH 6.8. The buffer can comprise to 0 to 500, 0 to 400, 0 to 300, 0 to 250, 0 to 200, 0 to 150, 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 5 to 150, 5 to 200, 5 to 250, 5 to 300, 5 to 400, 5 to 500, 25 to 50, 25 to 75, 25 to 100, 50 to 100, 50 150, 50 to 200, 50 to 250, 50 to 300, 100 to 200, 100 to 250, 100 to 300, or 150 to 250 mM KCl. In other instances the buffer comprises 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 10 to 20, 10 to 30, 10 to 40, 10 to 50, 15 to 20, 15 to 25, 15 to 30, 15 to 4, 15 to 50, 20 to 25, 20 to 30, 20 to 40, or 20 to 50 mM $MgCl_2$. The buffer can comprise 0 to 25, 0 to 20, 0 to 10, 0 to 5, 5 to 10, 5 to 15, 5 to 20, 5 to 25, 5 to 30% glycerol.

As another example, a buffer comprises 100 mM Imidazole pH 7.5; 250 mM KCl, 25 mM $MgCl_2$, 50 pg/mL BSA, 0.05% Igepal Ca-630, and 25% Glycerol. In some instances the buffer comprises 0 to 500, 0 to 400, 0 to 300, 0 to 250, 0 to 200, 0 to 150, 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 5 to 150, 5 to 200, 5 to 250, 5 to 300, 5 to 400, 5 to 500, 25 to 50, 25 to 75, 25 to 100, 50 to 100, 50 150, 50 to 200, 50 to 250, 50 to 300, 100 to 200, 100 to 250, 100 to 300, or 150 to 250 mM Imidazole pH 7.5. The buffer can comprise to 0 to 500, 0 to 400, 0 to 300, 0 to 250, 0 to 200, 0 to 150, 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 5 to 150, 5 to 200, 5 to 250, 5 to 300, 5 to 400, 5 to 500, 25 to 50, 25 to 75, 25 to 100, 50 to 100, 50 150, 50 to 200, 50 to 250, 50 to 300, 100 to 200, 100 to 250, 100 to 300, or 150 to 250 mM KCl. In other instances the buffer comprises 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 10 to 20, 10 to 30, 10 to 40, 10 to 50, 15 to 20, 15 to 25, 15 to 30, 15 to 4, 15 to 50, 20 to 25, 20 to 30, 20 to 40, or 20 to 50 mM $MgCl_2$. The buffer, in some instances, comprises 0 to 100, 0 to 75, 0 to 50, 0 to 25, 0 to 20, 0 to 10, 0 to 5, 5 to 50, 5 to 75, 5 to 100, 10 to 20, 10 to 50, 10 to 75, 10 to 100, 25 to 50, 25 to 75 25 to 100, 50 to 75, or 50 to 100 pg/mL BSA. In some instances, the buffer comprises 0 to 1, 0 to 0.5, 0 to 0.25, 0 to 0.01, 0 to 0.05, 0 to 0.025, 0 to 0.01, 0.01 to 0.025, 0.01 to 0.05, 0.01 to 0.1, 0.01 to 0.25, 0.01, to 0.5, 0.01 to 1, 0.025 to 0.05, 0.025 to 0.1, 0.025, to 0.5, 0.025 to 1, 0.05 to 0.1, 0.05 to 0.25, 0.05 to 0.5, 0.05 to 0.75, 0.05 to 1, 0.1 to 0.25, 0.1 to 0.5, or 0.1 to 1% Igepal Ca-630. The buffer can comprise 0 to 25, 0 to 20, 0 to 10, 0 to 5, 5 to 10, 5 to 15, 5 to 20, 5 to 25, 5 to 30% glycerol.

The methods for detection of a target nucleic acid described herein further can comprises reagents protease treatment of the sample. The sample can be treated with protease, such as Protease K, before amplification or before assaying for a detectable signal. Often, a protease treatment is for no more than 15 minutes. Sometimes, the protease treatment is for no more than 1, 5, 10, 15, 20, 25, 30, or more minutes, or any value from 1 to 30 minutes. Sometimes, the protease treatment is from 1 to 30, from 5 to 25, from 10 to 20, or from 10 to 15 minutes. Sometimes, the total time for the performing the method described herein is no greater than 3 hours, 2 hours, 1 hour, 50 minutes, 40 minutes, 30 minutes, 20 minutes, or any value from 3 hours to 20 minutes. Often, a method of nucleic acid detection from a raw sample comprises protease treating the sample for no more than 15 minutes, amplifying (can also be referred to as pre-amplifying) the sample for no more than 15 minutes, subjecting the sample to a programmable nuclease-mediated detection, and assaying nuclease mediated detection. The total time for performing this method, sometimes, is no greater than 3 hours, 2 hours, 1 hour, 50 minutes, 40 minutes, 30 minutes, 20 minutes, or any value from 3 hours to 20 minutes. Often, the protease treatment is Protease K. Often the amplifying is thermal cycling amplification. Sometimes the amplifying is isothermal amplification.

Enrichment of the Target Nucleic Acid Using a Targeting Protein

Enriching for the target nucleic acid in methods described herein can also enhance the assay detection of the target nucleic acid, such as for a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. Often, the segment of the target nucleic acid of the methods described herein comprise a mutation and the nucleic acid comprising at least 50% sequence identity to the segment of the target nucleic acid comprise a variant of the mutation. In some embodiments, a target nucleic acid is enriched in a sample prior to or concurrent with detection of the target nucleic acid using any of the methods disclosed herein.

The compositions for enrichment of target nucleic acids and methods of use thereof, as described herein, are compatible with the DETECTR assay methods disclosed herein. The methods of assaying for a target nucleic acid wherein a signal is detected, as described herein, are compatible with any of the programmable nucleases disclosed herein (e.g., a programmable nuclease with at least 60% sequence identity to SEQ ID NO: 11) and use of said programmable nuclease in a method of detecting a target nucleic acid. The compositions for enrichment of target nucleic acids and methods of use thereof, as described herein, are compatible with any of the compositions comprising a programmable nuclease and a buffer, which has been developed to improve the function of the programmable nuclease (e.g., a programmable nuclease and a buffer with low salt (about 110 mM or less) and a pH of 7 to 8) and use of said compositions in a method of detecting a target nucleic acid. The compositions for enrichment of target nucleic acids and methods of use thereof, as described herein, are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence.

A segment of the target nucleic acid may be enriched, for example, by depleting other nucleic acid species that do not correspond to the target nucleic acid from the sample. A segment of the target nucleic acid may be enriched, for example, by increasing the concentration of the target nucleic acid in the sample. In some cases, a nucleic acid species that does not correspond to the target nucleic acid may be a nucleic acid comprising a mutation relative to the target nucleic acid. In some cases, a nucleic acid species that does not correspond to the target nucleic acid may be a nucleic acid comprising a variation relative to the target nucleic acid. In some cases, the nucleic acid species that does not correspond to the target nucleic acid may be a region of a genome that does not comprise the target nucleic acid. In some cases, a nucleic acid species that does not correspond to the target nucleic acid may be a nucleic acid contaminant. The segment of the target nucleic acid in the sample may be enriched by targeting the nucleic acid species that does not correspond to the target nucleic acid with a protein that does not bind the segment of the target nucleic acid. For example, the protein may bind the nucleic acid comprising a mutation relative to the target nucleic acid but not to the segment of the target nucleic acid. Targeting the nucleic acid species that does not correspond to the target nucleic acid with the protein that does not bind the segment of the target nucleic acid may allow for the removal of the targeted nucleic acid. The segment of the target nucleic acid in the sample may be enriched by targeting the target nucleic acid with a protein that specifically binds the segment of the target nucleic acid. For example, the protein may bind the segment of target nucleic acid but not to a nucleic acid comprising a mutation relative to the target nucleic acid. Targeting the segment of the target nucleic acid with the protein that specifically binds the segment of the target nucleic acid may allow for the removal of the nucleic acids that are not targeted by the protein or isolation of the nucleic acids targeted by the protein. A protein may be targeted to the segment of the target nucleic acid, or the protein may be targeted to a nucleic acid that does not correspond to the target nucleic acid, or any combination thereof, before the contacting of the methods described herein.

For enrichment of the segment of the target nucleic acid by targeting the nucleic acids comprising a variant or a mutation relative to the target nucleic acid with a protein, the protein can be an antibody that binds to the variant or the mutation of the nucleic acid. Often, the protein is a programmable nuclease without endonuclease activity. Sometimes, the protein is attached to a surface and the sample is passed through the protein attached to surface. The nucleic acids comprising the variant mutation are therefore removed from the flow through, leaving a sample with enriched target nucleic acid.

Alternatively, for enrichment of the segment of the target nucleic acid by targeting the segment of the target nucleic acid with a protein, the protein can be an antibody that binds to the target nucleic acid. Often, the protein is a programmable nuclease without endonuclease activity. Sometimes, the protein is attached to a surface and the sample is passed through the protein attached to surface. The target nucleic acids therefore bound to the protein and other nucleic acids are separated from the target nucleic acids in the flow through. The bound target nucleic acids can then be released from the protein, leaving a sample with the enriched segments of the target nucleic acids.

Detection of a Mutation in a Target Nucleic Acid

Disclosed herein are methods of assaying for a target nucleic acid as described herein that can be used for detection of a single nucleotide mutation (single nucleotide polymorphism, SNP) in a target nucleic acid. The compositions for detection of a mutation in a target nucleic acid and methods of use thereof, as described herein, are compatible with the DETECTR assay methods disclosed herein. The compositions for detection of a mutation in a target nucleic acid and methods of use thereof, as described herein, are compatible with any of the programmable nucleases disclosed herein (e.g., a programmable nuclease with at least 60% sequence identity to SEQ ID NO: 11) and use of said programmable nuclease in a method of detecting a target nucleic acid. The compositions for detection of a mutation in a target nucleic acid and methods of use thereof, as described herein, are compatible with any of the compositions comprising a programmable nuclease and a buffer, which has been developed to improve the function of the programmable nuclease (e.g., a programmable nuclease and a buffer with low salt (about 110 mM or less) and a pH of 7 to 8) and use of said compositions in a method of detecting a target nucleic acid. The compositions for detection of a mutation in a target nucleic acid and methods of use thereof, as described herein, are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence. The SNP can be a synonymous substitution or a nonsynonymous substitution. The nonsynonymous substitution can be a missense substitution or a nonsense point mutation. The synonymous substitution can be a silent substitution. Sometimes, the methods can be used for detection of a deletion in a target nucleic acid. For example, A method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. Sometimes, the target nucleic acid comprises a mutation. Often, the mutation is a single nucleotide mutation. Alternatively, the mutation is a deletion.

A target nucleic acid may be present in a heterogenous sample, for example a sample comprising the target nucleic acid and a nucleic acid with less than 100% sequence identity to the target nucleic acid (e.g., a target nucleic acid comprising a mutation and a nucleic acid that does not comprise the mutation). The target nucleic acid may be present in the heterogenous sample at a minor allele frequency of 10% or less. For example, the target nucleic acid may comprise less than 10% of the nucleic acid population comprising the target nucleic acid comprising a mutation and a nucleic acid that does not comprise the mutation. In some embodiments, the target nucleic acid may be present in the sample at a minor allele frequency of from 0.1% to 10%. In some embodiments, the target nucleic acid may be present in the sample at a minor allele frequency of from 0.1% to 5%. In some embodiments, the target nucleic acid may be present in the sample at a minor allele frequency of from 0.1% to 1%. In some embodiments, the segment of the nucleic acid or the segment of the target nucleic acid comprises at least one base mutation compared to at least one other segment of a nucleic acid in the sample. In some embodiments, the at least one base mutation is no more than 13 nucleotides 3' of the PAM in the nucleic acid or the PAM target nucleic acid. In some embodiments, the at least one base mutation is no more than 10 nucleotides 3' of the PAM in the nucleic acid or the PAM target nucleic acid. In some embodiments, the at least one base mutation is no more than 9 nucleotides 3' of the PAM in the nucleic acid or in the PAM target nucleic acid. In some embodiments, the at least one base mutation is no more than 8 nucleotides 3' of the PAM in the nucleic acid or in the PAM target nucleic acid. In some embodiments, the at least one base mutation is a single nucleotide polymorphism.

Also disclosed herein are methods of assaying for a target nucleic acid as described herein that can be used for detection of a single nucleotide mutation in a target nucleic acid. For example, a method of assaying for a target nucleic acid segment in a sample, wherein the target nucleic acid segment lacks a PAM sequence, comprises amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample. Sometimes, the target nucleic acid comprises a mutation. Often, the mutation is a single nucleotide mutation.

Methods described herein can be used to identify a mutation in a target nucleic acid. The methods can be used to identify a single nucleotide mutation of a target nucleic acid that affects the expression of a gene. A mutation that affects the expression of gene can be a single nucleotide mutation of a target nucleic acid within the gene, a single nucleotide mutation of a target nucleic acid comprising RNA associated with the expression of a gene, or a target nucleic acid comprising a single nucleotide mutation of a nucleic acid associated with regulation of expression of a gene, such as an RNA or a promoter, enhancer, or repressor of the gene. A mutation that affects the expression of a gene can be a deletion of one or more nucleic acids within the gene, a deletion of one or more target nucleic acids comprising RNA associated with the expression of a gene, or a target nucleic acid comprising a deletion of one or more nucleic acids associated with regulation of expression of a gene, such as an RNA or a promoter, enhancer, or repressor of the gene. Often, a status of a mutation is used to diagnose or identify diseases associated with the mutation of target nucleic acid. Detection of target nucleic acids having a mutation are applicable to a number of fields, such as clinically, as a diagnostic, in laboratories as a research tool, and in agricultural applications. Often, the mutation is a single nucleotide mutation. Alternatively, the mutation is a deletion.

Disease Detection

Disclosed herein are methods of assaying for a target nucleic acid as described herein that can be used for disease detection. For example, a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. The detection of the signal can indicate the presence of the target nucleic acid. Sometimes, the target nucleic acid comprises a mutation. Often, the mutation is a single nucleotide mutation. Alternatively, the mutation is a deletion. In some embodiments, a method may further comprise administering a treatment for the disease being detected. Any of the methods described herein may be used in diagnosis, wherein a Cas12 nuclease detects a segment of a target nucleic acid. Any of the compositions described herein may be used in diagnosis. Any of the programmable nucleases described herein may be used in diagnosis, wherein the programmable nuclease detects the target nucleic acid.

Also disclosed herein are methods of assaying for a target nucleic acid as described herein that can be used for disease detection. For example, a method of assaying for a target nucleic acid segment in a sample, wherein the target nucleic acid segment lacks a PAM sequence, comprises amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample. Sometimes, the target nucleic acid comprises a mutation. Often, the mutation is a single nucleotide mutation.

The methods as described herein can be used to identify or diagnose a cancer or genetic disorder associated with a mutation in a target nucleic acid. The methods can be used to identify a mutation of a target nucleic acid that affects the expression of a cancer gene. A cancer gene can be any gene whose aberrant expression is associated with cancer, such as overexpression of an oncogene, suppression of tumor suppressor gene, or dysregulation of a checkpoint inhibitor gene or gene associated with cellular growth, cellular metabolism, or the cell cycle. A mutation that affects the expression of cancer gene can be a mutation of a target nucleic acid within the cancer gene, a mutation of a target nucleic acid comprising RNA associated with the expression of a cancer gene, or a target nucleic acid comprising a mutation of a nucleic acid associated with regulation of expression of a cancer gene, such as an RNA or a promoter, enhancer, or repressor of the cancer gene. For example, a target nucleic acid comprising a mutation that affects a cancer gene can contribute to or lead to colon cancer, bladder cancer, stomach cancer, breast cancer, non-small-cell lung cancer, pancreatic cancer, esophageal cancer, cervical cancer, ovarian cancer, hepatocellular cancer, and acute myeloid leukemia. The target nucleic acid comprise a mutation of a cancer gene or RNA expressed from a cancer gene. Often, the mutation is a single nucleotide mutation. Alternatively, the mutation is a deletion.

The methods can be used to identify a mutation that affects the expression of a gene associated with a genetic disorder. A gene associated with a genetic disorder can be a gene whose overexpression is associated with a genetic disorder, from a gene associated with abnormal cellular growth resulting in a genetic disorder, or from a gene associated with abnormal cellular metabolism resulting in a genetic disorder. A mutation that affects the expression of a gene associated with a genetic disorder can be mutation within the gene associated with a genetic disorder, a mutation of RNA associated with a gene of the genetic disorder, or a mutation of a nucleic acid associated with regulation of expression of a gene associated with a genetic disorder, such as an RNA or a promoter, enhancer, or repressor of the gene associated with the genetic disorder. Often, the mutation is a single nucleotide mutation. Alternatively, the mutation is a deletion.

Methods described herein can be used to identify a mutation in a target nucleic acid from a bacteria, virus, or microbe. The methods can be used to identify a mutation of a target nucleic acid that affects the expression of a gene. A mutation that affects the expression of gene can be a mutation of a target nucleic acid within the gene, a mutation of a target nucleic acid comprising RNA associated with the expression of a gene, or a target nucleic acid comprising a mutation of a nucleic acid associated with regulation of expression of a gene, such as an RNA or a promoter, enhancer, or repressor of the gene. Sometimes, a status of a target nucleic acid mutation is used to determine a pathogenicity of a bacteria, virus, or microbe or treatment resistance, such as resistance to antibiotic treatment. Often, a status of a mutation is used to diagnose or identify diseases associated with the mutation of target nucleic acid sequences in the bacteria, virus, or microbe. Often, the mutation is a single nucleotide mutation. Alternatively, the mutation is a deletion.

Detection as a Research Tool

Disclosed herein are methods of assaying for a target nucleic acid as described herein that can be used as a research tool. For example, a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid;

and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. The detection of the signal can indicate the presence of the target nucleic acid. Sometimes, the target nucleic acid comprises a mutation. Often, the mutation is a single nucleotide mutation. Alternatively, the mutation is a deletion.

Also disclosed herein are methods of assaying for a target nucleic acid as described herein that can be used as a research tool. For example, a method of assaying for a target nucleic acid segment in a sample, wherein the target nucleic acid segment lacks a PAM sequence, comprises amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample. Sometimes, the target nucleic acid comprises a mutation. Often, the mutation is a single nucleotide mutation.

The methods as described herein can be used to identify a single nucleotide mutation in a target nucleic acid. The methods described herein can be used to identify a deletion in a target nucleic acid. The methods can be used to identify mutation of a target nucleic acid that affects the expression of a gene. A mutation that affects the expression of gene can be a single nucleotide mutation of a target nucleic acid within the gene, a mutation of a target nucleic acid comprising RNA associated with the expression of a gene, or a target nucleic acid comprising a mutation of a nucleic acid associated with regulation of expression of a gene, such as an RNA or a promoter, enhancer, or repressor of the gene. A mutation that affects the expression of gene can be a deletion of one or more nucleic acids within the gene, a deletion of one or more target nucleic acids comprising RNA associated with the expression of a gene, or a target nucleic acid comprising a deletion of one or more nucleic acids associated with regulation of expression of a gene, such as an RNA or a promoter, enhancer, or repressor of the gene. Often, the mutation is a single nucleotide mutation. Alternatively, the mutation is a deletion.

Detection for Agricultural Applications

Disclosed herein are methods of assaying for a target nucleic acid as described herein that can be used for agricultural applications. For example, a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. The detection of the signal can indicate the presence of the target nucleic acid. Sometimes, the target nucleic acid comprises a mutation. Often, the mutation is a single nucleotide mutation. Alternatively, the mutation is a deletion.

Also disclosed herein are methods of assaying for a target nucleic acid as described herein that can be used for agricultural applications. For example, a method of assaying for a target nucleic acid segment in a sample, wherein the target nucleic acid segment lacks a PAM sequence, comprises amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample. The detection of the signal can indicate the presence of the target nucleic acid. Sometimes, the target nucleic acid comprises a mutation. Often, the mutation is a single nucleotide mutation.

The methods as described herein can be used to identify a mutation in a target nucleic acid of a plant or of a bacteria, virus, or microbe associated with a plant or soil. The methods can be used to identify a mutation of a target nucleic acid that affects the expression of a gene. A mutation that affects the expression of gene can be a mutation of a target nucleic acid within the gene, a mutation of a target nucleic acid comprising RNA associated with the expression of a gene, or a target nucleic acid comprising a mutation of a nucleic acid associated with regulation of expression of a gene, such as an RNA or a promoter, enhancer, or repressor of the gene. Often, the mutation is a single nucleotide mutation. Alternatively, the mutation is a deletion.

Amplification of Target Nucleic Acids

Disclosed herein are methods of amplifying a target nucleic acid for detection using any of the methods, reagents, kits or devices described herein. The compositions for amplification of target nucleic acids and methods of use thereof, as described herein, are compatible with the DETECTR assay methods disclosed herein. The compositions for amplification of target nucleic acids and methods of use thereof, as described herein, are compatible with any of the programmable nucleases disclosed herein (e.g., a programmable nuclease with at least 60% sequence identity to SEQ ID NO: 11) and use of said programmable nuclease in a method of detecting a target nucleic acid. The compositions for amplification of target nucleic acids and methods of use thereof, as described herein, are compatible with any of the compositions comprising a programmable nuclease and a buffer, which has been developed to improve the function of the programmable nuclease (e.g., a programmable nuclease and a buffer with low salt (about 110 mM or less) and a pH of 7 to 8) and use of said compositions in a method of detecting a target nucleic acid. The compositions for amplification of target nucleic acids and methods of use thereof, as described herein, are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence. In some cases, amplification of the target nucleic acid may increase the sensitivity of a detection reaction. In some cases, amplification of the target nucleic acid may increase the specificity of a detection reaction. Amplification of the target nucleic acid may increase the concentration of the target nucleic acid in the sample relative to the concentration of nucleic acids that do not correspond to the target nucleic acid. In some embodiments, amplification of the target nucleic acid may be used to modify the sequence of the target nucleic acid. For example, amplification may be used to insert a PAM sequence into a target nucleic acid that lacks a PAM sequence. In some cases, amplification may be used to increase the homogeneity of a target nucleic acid sequence. For example, amplification may be used to remove a nucleic acid variation that is not of interest in the target nucleic acid sequence.

An amplified target nucleic acid may be present in a DETECTR reaction in an amount relative to an amount of a programmable nuclease. In some embodiments, the amplified target nucleic acid is present in at least 1-fold, 2-fold, 3-fold, 4-fold, 5-fold, 10-fold, 25-fold, 50-fold, 100-fold, 500-fold, 1000-fold, 10,000-fold, or 100,000-fold molar excess relative to the amount of the programmable nuclease. In some embodiments, the amplified target nucleic acid is present in no more than 1-fold, 2-fold, 3-fold, 4-fold, 5-fold, 10-fold, 25-fold, 50-fold, 100-fold, 500-fold, 1000-fold, 10,000-fold, or 100,000-fold molar excess relative to the amount of the programmable nuclease. In some embodiments, the amplified target nucleic acid is present in from 1-fold to 2-fold, from 1-fold to 3-fold, from 1-fold to 4-fold, from 1-fold to 5-fold, from 1-fold to 10-fold, from 1-fold to 25-fold, from 1-fold to 50-fold, from 1-fold to 100-fold, from 1-fold to 500-fold, from 1-fold to 1000-fold, from 1-fold to 10,000-fold, from 1-fold to 100,000-fold, from 5-fold to 10-fold, from 5-fold to 25-fold, from 5-fold to 50-fold, from 5-fold to 100-fold, from 5-fold to 500-fold, from 5-fold to 1000-fold, from 5-fold to 10,000-fold, from 5-fold to 100,000-fold, from 10-fold to 25-fold, from 10-fold to 50-fold, from 10-fold to 100-fold, from 10-fold to 500-fold, from 10-fold to 1000-fold, from 10-fold to 10,000-fold, from 10-fold to 100,000-fold, from 100-fold to 500-fold, from 100-fold to 1000-fold, from 100-fold to 10,000-fold, from 100-fold to 100,000-fold, from 1000-fold to 10,000-fold, from 1000-fold to 100,000-fold, or from 10,000-fold to 100,000-fold molar excess relative to the amount of the programmable nuclease. In some embodiments, the programmable nuclease is present in at least 1-fold, 2-fold, 3-fold, 4-fold, 5-fold, 10-fold, 25-fold, 50-fold, 100-fold, 500-fold, 1000-fold, 10,000-fold, or 100,000-fold molar excess relative to the amount of the target nucleic acid. In some embodiments, the programmable nuclease is present in no more than 1-fold, 2-fold, 3-fold, 4-fold, 5-fold, 10-fold, 25-fold, 50-fold, 100-fold, 500-fold, 1000-fold, 10,000-fold, or 100,000-fold molar excess relative to the amount of the target nucleic acid. In some embodiments, the programmable nuclease is present in from 1-fold to 2-fold, from 1-fold to 3-fold, from 1-fold to 4-fold, from 1-fold to 5-fold, from 1-fold to 10-fold, from 1-fold to 25-fold, from 1-fold to 50-fold, from 1-fold to 100-fold, from 1-fold to 500-fold, from 1-fold to 1000-fold, from 1-fold to 10,000-fold, from 1-fold to 100,000-fold, from 5-fold to 10-fold, from 5-fold to 25-fold, from 5-fold to 50-fold, from 5-fold to 100-fold, from 5-fold to 500-fold, from 5-fold to 1000-fold, from 5-fold to 10,000-fold, from 5-fold to 100,000-fold, from 10-fold to 25-fold, from 10-fold to 50-fold, from 10-fold to 100-fold, from 10-fold to 500-fold, from 10-fold to 1000-fold, from 10-fold to 10,000-fold, from 10-fold to 100,000-fold, from 100-fold to 500-fold, from 100-fold to 1000-fold, from 100-fold to 10,000-fold, from 100-fold to 100,000-fold, from 1000-fold to 10,000-fold, from 1000-fold to 100,000-fold, or from 10,000-fold to 100,000-fold molar excess relative to the amount of the target nucleic acid. In some embodiments, the target nucleic acid is not present in the sample.

An amplified target nucleic acid may be present in a DETECTR reaction in an amount relative to an amount of a guide nucleic acid. In some embodiments, the amplified target nucleic acid is present in at least 1-fold, 2-fold, 3-fold, 4-fold, 5-fold, 10-fold, 25-fold, 50-fold, 100-fold, 500-fold, 1000-fold, 10,000-fold, or 100,000-fold molar excess relative to the amount of the guide nucleic acid. In some embodiments, the amplified target nucleic acid is present in no more than 1-fold, 2-fold, 3-fold, 4-fold, 5-fold, 10-fold, 25-fold, 50-fold, 100-fold, 500-fold, 1000-fold, 10,000-fold, or 100,000-fold molar excess relative to the amount of the guide nucleic acid. In some embodiments, the amplified target nucleic acid is present in from 1-fold to 2-fold, from 1-fold to 3-fold, from 1-fold to 4-fold, from 1-fold to 5-fold, from 1-fold to 10-fold, from 1-fold to 25-fold, from 1-fold to 50-fold, from 1-fold to 100-fold, from 1-fold to 500-fold, from 1-fold to 1000-fold, from 1-fold to 10,000-fold, from 1-fold to 100,000-fold, from 5-fold to 10-fold, from 5-fold to 25-fold, from 5-fold to 50-fold, from 5-fold to 100-fold, from 5-fold to 500-fold, from 5-fold to 1000-fold, from 5-fold to 10,000-fold, from 5-fold to 100,000-fold, from 10-fold to 25-fold, from 10-fold to 50-fold, from 10-fold to 100-fold, from 10-fold to 500-fold, from 10-fold to 1000-fold, from 10-fold to 10,000-fold, from 10-fold to 100,000-fold, from 100-fold to 500-fold, from 100-fold to 1000-fold, from 100-fold to 10,000-fold, from 100-fold to 100,000-fold, from 1000-fold to 10,000-fold, from 1000-fold to 100,000-fold, or from 10,000-fold to 100,000-fold molar excess relative to the amount of the guide nucleic acid. In some embodiments, the guide nucleic acid is present in at least 1-fold, 2-fold, 3-fold, 4-fold, 5-fold, 10-fold, 25-fold, 50-fold, 100-fold, 500-fold, 1000-fold, 10,000-fold, or 100,000-fold molar excess relative to the amount of the target nucleic acid. In some embodiments, the guide nucleic acid is present in no more than 1-fold, 2-fold, 3-fold, 4-fold, 5-fold, 10-fold, 25-fold, 50-fold, 100-fold, 500-fold, 1000-fold, 10,000-fold, or 100,000-fold molar excess relative to the amount of the target nucleic acid. In some embodiments, the guide nucleic acid is present in from 1-fold to 2-fold, from 1-fold to 3-fold, from 1-fold to 4-fold, from 1-fold to 5-fold, from 1-fold to 10-fold, from 1-fold to 25-fold, from 1-fold to 50-fold, from 1-fold to 100-fold, from 1-fold to 500-fold, from 1-fold to 1000-fold, from 1-fold to 10,000-fold, from 1-fold to 100,000-fold, from 5-fold to 10-fold, from 5-fold to 25-fold, from 5-fold to 50-fold, from 5-fold to 100-fold, from 5-fold to 500-fold, from 5-fold to 1000-fold, from 5-fold to 10,000-fold, from 5-fold to 100,000-fold, from 10-fold to 25-fold, from 10-fold to 50-fold, from 10-fold to 100-fold, from 10-fold to 500-fold, from 10-fold to 1000-fold, from 10-fold to 10,000-fold, from 10-fold to 100,000-fold, from 100-fold to 500-fold, from 100-fold to 1000-fold, from 100-fold to 10,000-fold, from 100-fold to 100,000-fold, from 1000-fold to 10,000-fold, from 1000-fold to 100,000-fold, or from 10,000-fold to 100,000-fold molar excess relative to the amount of the target nucleic acid. In some embodiments, the target nucleic acid is not present in the sample.

Amplification for Insertion of a PAM Sequence

Amplification methods can also enhance the assay detection of the target nucleic acid, such as enhancing a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. For example, amplification of a target nucleic acid with primers encoding a PAM sequence to insert the PAM sequence into the sequence of the target nucleic acid before the contacting. More specifically, a PAM target nucleic acid comprising a sequence encoding a PAM sequence (e.g., TTTN or dUdUdUN) is produced by amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product. Often, a sequence encoding a PAM sequence is TTTN. Sometimes, a sequence encoding a PAM is dUdUdUN. This allows for any target nucleic acid to be used with a programmable nuclease (e.g., Cas12) that requires the target nucleic acid to comprise a sequence encoding a PAM for activation of the programmable nuclease complexed with the guide nucleic acid. This allows for any target nucleic acid to be used with a programmable nuclease (e.g., Cas12) that requires the target nucleic acid to comprise a sequence encoding a PAM for binding to the guide nucleic acid. One or more steps of the method as disclosed herein may be performed in a common reaction volume (e.g., a single reaction mixture). Often, the method as disclosed herein is performed in a common reaction volume.

Often, the primer is a forward primer. For example, the forward primer comprises the sequence encoding the PAM. Sometimes, the forward primer comprises from 1 to 20 nucleotides from the 3' end of the sequence encoding the PAM. Often, the forward primer comprises from 1 to 8 nucleotides from the 3' end of the sequence encoding the PAM. The forward primer can comprise 6 nucleotides from the 3' end of the sequence encoding the PAM. The forward primer can comprise 7 nucleotides from the 3' end of the sequence encoding the PAM. The forward primer can comprise 8 nucleotides from the 3' end of the sequence encoding the PAM. Sometimes, these nucleotides from the 3' end of the sequence encoding the PAM is referred are referred to extension nucleotides (e.g., 6 nucleotide extension).

Often, a mutation in the target nucleic acid amplified using the primer is located a certain number of nucleotides downstream of the 5' end of the target nucleic acid segment wherein the target nucleic acid segment is a segment that binds to a segment of the guide nucleic acid that is reverse complementary to it and comprises the sequence encoding the PAM. Sometimes, the mutation is a single nucleotide mutation or a SNP (e.g., a synonymous mutation or a non-synonymous mutation such as a missense substitution or a nonsense point mutation). Sometimes, the mutation is a deletion. Often, the mutation is from 3 to 20 nucleotides downstream of the target nucleic acid segment. Sometimes, the mutation is from 5 to 9 nucleotides downstream of the target nucleic acid segment. The mutation can be 6 nucleotides downstream of the target nucleic acid segment. The mutation can be 7 nucleotides downstream of the target nucleic acid segment. The mutation can be 8 nucleotides downstream of the target nucleic acid segment.

A method of assaying for a target nucleic acid segment in a sample, wherein the target nucleic acid segment lacks a PAM sequence, comprises amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample. Often, a sequence encoding a PAM sequence is TTTN. Sometimes, a sequence encoding a PAM is dUdUdUN. This allows for any target nucleic acid to be used with a programmable nuclease (e.g., Cas12) that requires the target nucleic acid to comprise a sequence encoding a PAM for activation of the programmable nuclease complexed with the guide nucleic acid. One or more steps of the method as disclosed herein may be performed in a common reaction volume (e.g., a single reaction mixture). Often, the method as disclosed herein is performed in a common reaction volume.

Often, the forward primer comprises the sequence encoding the PAM. Sometimes, the PAM forward primer comprises from 1 to 20 nucleotides from the 3' end of the sequence encoding the PAM. Often, the PAM forward primer comprises from 1 to 8 nucleotides from the 3' end of the sequence encoding the PAM. Sometimes, the PAM forward primer comprises from 1 to 2 or 4 to 8 nucleotides from the 3' end of the sequence encoding the PAM. Often a PAM forward primer comprising from 1 to 2 or 4 to 8 nucleotides from the 3' end of the sequence encoding the PAM is a PAM sequence comprising dUdUdUN. The PAM forward primer can comprise 1 nucleotides from the 3' end of the sequence encoding the PAM. The PAM forward primer can comprise 2 nucleotides from the 3' end of the sequence encoding the PAM. The PAM forward primer can comprise 3 nucleotides from the 3' end of the sequence encoding the PAM. The PAM forward primer can comprise 4 nucleotides from the 3' end of the sequence encoding the PAM. The PAM forward primer can comprise 5 nucleotides from the 3' end of the sequence encoding the PAM. The PAM forward primer can comprise 6 nucleotides from the 3' end of the sequence encoding the PAM. The PAM forward primer can comprise 7 nucleotides from the 3' end of the sequence encoding the PAM. The PAM forward primer can comprise 8 nucleotides from the 3' end of the sequence encoding the PAM. Sometimes, these nucleotides from the 3' end of the sequence encoding the PAM is referred are referred to extension nucleotides (e.g., 6 nucleotide extension).

Often, a mutation in the target nucleic acid (also referred to as the mismatch) amplified using PAM primers is located a certain number of nucleotides downstream of the 5' end of the PAM in PAM target nucleic acid. Sometimes, the mutation or mismatch is a single nucleotide mutation or a SNP. Often, the mismatch is from 3 to 20 nucleotides downstream of the PAM in PAM target nucleic acid. The mismatch can be from 3 to 10 nucleotides downstream of the PAM in PAM target nucleic acid. Sometimes, the mismatch is from 5 to 9 nucleotides downstream of the PAM in PAM target nucleic acid. The mutation can be 6 nucleotides downstream of the PAM in PAM target nucleic acid. The mutation can be 7 nucleotides downstream of the PAM in PAM target nucleic acid. The mutation can be 8 nucleotides downstream of the PAM in PAM target nucleic acid.

The amplification that produces the PAM target nucleic acid can be performed for no greater than 1, 2, 3, 4, 5, 6, 7, 8, 9, 10, 11, 12, 13, 14, 15, 16, 17, 18, 19, 20, 25, 30, 40, 50, or 60 minutes. Sometimes, the amplification reaction is performed at a temperature of around 20-45° C. The amplification reaction can be performed at a temperature no greater than 20° C., 25° C., 30° C., 35° C., 37° C., 40° C., 45° C. The reaction can be performed at a temperature of at least 20° C., 25° C., 30° C., 35° C., 37° C., 40° C., or 45° C. Sometimes, the amplification is performed with dTTP, dATP, dCTP, and dGTP. Often the amplification is performed with dUTP, dATP, dCTP, and dGTP. In some embodiments, an amplified target nucleic acid comprises dU nucleic acids.

The amplification that produces the PAM target nucleic acid can be thermal cycling amplification or isothermal amplification. The reagents for the amplification can comprise a recombinase, a oligonucleotide primer, a single-stranded DNA binding (SSB) protein, and a polymerase. The isothermal amplification can be transcription mediated amplification (TMA). Isothermal amplification can be helicase dependent amplification (HDA) or circular helicase dependent amplification (cHDA). In additional cases, isothermal amplification is strand displacement amplification (SDA). The isothermal amplification can be recombinase polymerase amplification (RPA). The isothermal amplification can be at least one of loop mediated amplification (LAMP) or the exponential amplification reaction (EXPAR). Isothermal amplification is, in some cases, by rolling circle amplification (RCA), ligase chain reaction (LCR), simple method amplifying RNA targets (SMART), single primer isothermal amplification (SPIA), multiple displacement amplification (MDA), nucleic acid sequence based amplification (NASBA), hinge-initiated primer-dependent amplification of nucleic acids (HIP), nicking enzyme amplification reaction (NEAR), or improved multiple displacement amplification (IMDA). In a preferred embodiment, the isothermal amplification is LAMP.

Various compositions are compatible with the amplification methods described herein. In some embodiments, a composition may comprise a nucleic acid from a sample, wherein the nucleic acid comprises a PAM and a segment that hybridizes to a guide nucleic acid, wherein the PAM has a sequence of dUdUdUN, a guide nucleic acid that hybridizes to the segment of the nucleic acid, and a programmable nuclease that exhibits sequence independent cleavage of a detector nucleic acid upon hybridization of the guide nucleic acid to the segment of the target nucleic acid. A composition may further comprise a primer, wherein the primer comprises a first region that is reverse complementary to the PAM and a second region that is reverse complementary to a first segment of the nucleic acid.

Various methods of assaying are compatible with the amplification methods described herein. In some embodiments, a method of assaying for a target nucleic acid in a sample, wherein the target nucleic acid lacks a PAM may comprise amplifying the target nucleic acid from a sample using a primer comprising a first region that is reverse complementary to a PAM and a second region that is reverse complementary to a first segment of the target nucleic acid, wherein the PAM is dUdUdUN, thereby producing a PAM target nucleic acid, contacting the PAM target nucleic acid to a guide nucleic acid that hybridizes to a segment of the PAM target nucleic acid, a programmable nuclease that exhibits sequence independent cleavage of a detector nucleic acid upon hybridization of the guide nucleic acid to a segment of the PAM target nucleic acid, and a detector nucleic acid, and assaying for a signal produced by cleavage of the detector nucleic acid. In some embodiments, the second region comprises from 4 to 12 bases. In some embodiments, the second region comprises from 4 to 10 bases. In some embodiments, the second region comprises from 4 to 7 bases.

Amplification Using Blocking Primer

Amplification methods can also enhance the assay detection of the target nucleic acid, such as enhancing a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample.

The methods described herein may comprise amplifying the target prior to detection. In some embodiments, amplifying may comprise using a blocking primer. In some cases, amplification may be performed in the presence of a blocking primer to block amplification of a nucleic acid sequence comprising a mutation or a variation relative to the target nucleic acid. The mutation can be a single nucleotide mutation, a SNP, or a deletion. The variant can be the wild type variant of the mutation (e.g., the wild type variant of the single nucleotide mutation or the wild type variant of the SNP). For example, the blocking primer may bind to a nucleic acid region comprising the mutation relative to the target nucleic acid but may not bind to the target nucleic acid that does not comprise the mutation. In some embodiments, the blocking primer binds to a nucleic acid comprising encoding the wild type sequence of the target nucleic acid segment. Binding of the blocking primer to the nucleic acid region comprising the mutation may prevent amplification of the nucleic acid sequence comprising the mutation. Often, the blocking primer comprises a 3' phosphate. The blocking primer may be a primer incapable of initiating nucleic acid extension. The blocking primer may prevent binding of a primer that is capable of initiating nucleic acid extension. In some cases, the blocking primer can bind perfectly to the nucleic acid comprising the variant mutation. Amplification in the presence of the blocking primer may be performed before the contacting of the methods described herein.

The use of a blocking primer results in selective amplification of the target nucleic acid. This occurs using standard PCR conditions when a blocking primer is added with a forward primer and a reverse primer. The blocking primer and either the forward or the reverse primer encode at least part of a sequence that overlaps with the sequence of the blocking primer. In this PCR reaction, the blocking primer binds to a variant of the mutation of the target nucleic acid and blocks either the forward primer or the reverse primer (depending on which primer comprises the overlapping sequence with the blocking primer) from priming the extension of the nucleic acid comprising variant of the mutation of the target nucleic acid, and thus the nucleic acid comprising the variant of the mutation of the target nucleic acid is not amplified. In contrast, the blocking primer does not bind the mutation of the target nucleic acid and does not block either the forward primer or the reverse primer (depending on which primer comprises the overlapping sequence with the blocking primer) from priming the extension of the nucleic acid comprising variant of the mutation of the target nucleic acid, and thus the target nucleic acid is selectively amplified. This results in target nucleic acid enrichment in the before the contacting step of the methods described herein.

COLD-PCR Amplification

Amplification methods can also enhance the assay detection of the target nucleic acid, such as enhancing a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. For example, amplification is performed using co-amplification at lower denaturation temperature PCR (COLD-PCR), such as full COLD-PCR and fast COLD-PCR, before the contacting of the methods described herein. In some embodiments, amplifying comprises fast COLD-PCR. In some embodiments, amplifying comprises allele-specific COLD-PCR. In some embodiments, amplifying comprises COLD-PCR. Often, the target nucleic acid is from 0.05% to 20% of total nucleic acids in the sample in these methods.

The mismatches from mutations in the segment of the target nucleic acid, such as a single nucleotide mutation or a deletion, compared to a nucleic acid comprising at least 50% sequence identity to the segment of the target nucleic acid, result in altering the melting temperature (Tm) of a double stranded DNA comprising the segment of the target nucleic acid. For example, a target nucleic acid comprising the segment of the target nucleic acid has a Tm that is from 0.1 to 5 C lower than the nucleic acid comprising at least 50% sequence identity to segment of the target nucleic acid. Both full COLD-PCR and fast COLD-PCR are based on this principle and can be used to selectively amplify the target nucleic acid comprising the mutation.

For performing amplification using full COLD-PCR, the sample comprising the segment of the target nucleic acid and nucleic acid comprising at least 50% sequence identity to the segment of the target nucleic acid can undergo a denaturation step, such as denaturation at high temperature (e.g., about 94° C. or higher). Next, the temperature is changed to an intermediate annealing temperature that allows hybridization of the segment of the target nucleic acid and the nucleic acid comprising at least 50% sequence identity to the segment of the target nucleic acid to one another. After hybridization, the heteroduplexes of the segment of the target nucleic acid and the nucleic acid comprising at least 50% sequence identity to the segment of the target nucleic acid melt at lower temperatures for denaturation (at a Tc temperature which is a critical temperature of the double stranded DNA that is lower than its Tm) while the homoduplexes of the segment of the target nucleic acid or the homoduplexes of the nucleic acid comprising at least 50% sequence identity to the segment of the target nucleic acid remain double stranded. Mismatched sequences (e.g., heteroduplexes of the segment of the target nucleic acid and the nucleic acid comprising at least 50% sequence identity to the segment of the target nucleic acid) may be selectively denatured at a critical temperature ("Tc," e.g., about 86.5° C.). Matched sequences (e.g., homoduplexes of the segment of the target nucleic acid or the homoduplexes of the nucleic acid comprising at least 50% sequence identity to the segment of the target nucleic acid) may remain double stranded during selective denaturation of the mismatched sequences. Primers can then anneal to the denatured strands and a DNA polymerase can extend these strands. Since only heteroduplexes of the segment of the target nucleic acid and the nucleic acid comprising at least 50% sequence identity to the segment of the target nucleic acid are available for amplification, a larger portion of the target nucleic acid is amplified and also becomes available for amplification is subsequent rounds. FIG. 64A illustrates an exemplary protocol of full COLD-PCR.

For performing amplification using fast COLD-PCR, the Tm of the segment of the target nucleic acid is lower than the Tm of the nucleic acid comprising at least 50% sequence identity to the segment of the target nucleic acid. Thus, fast COLD-PCR can enrich for segment of the target nucleic acids comprising a mutation that results in a lower Tm than the Tm of the nucleic acid comprising at least 50% sequence identity to the segment of the target nucleic acid. For fast COLD-PCR, the sample comprising the segment of the target nucleic acid and nucleic acid comprising at least 50% sequence identity to the segment of the target nucleic acid can undergo a denaturation step, such as denaturation at high temperature (e.g., 94° C.). Next, the temperature is reduced so that primers can then anneal to the denatured strands of the segment of the target nucleic acid and a DNA polymerase can extend these strands. Since the segment of the target nucleic acid can be denatured at a lower temperature than the nucleic acid comprising at least 50% sequence identity to the segment of the target nucleic acid, the segment of the target nucleic acid is amplified while the nucleic acid comprising at least 50% sequence identity to segment of the target nucleic acid remains double stranded. Mutant sequences (e.g., the segment of the target nucleic acid comprising a mutation) may be selectively denatured at a critical temperature ("Tc," e.g., about 86.5° C.). Wild type sequences (e.g., the nucleic acid comprising at least 50% sequence identity to the segment of the target nucleic acid)

may remain double stranded during selective denaturation of the mutant sequences. FIG. 64B illustrates an exemplary protocol of fast COLD-PCR.

In some embodiments, a composition comprising a Cas12 programmable nuclease (e.g., SEQ ID NO: 11) is at a temperature of from 25° C. to 45° C. The Cas12 programmable nuclease (e.g., SEQ ID NO: 11) may exhibit catalytic activity at a temperature of from 25° C. to 45° C. The Cas12 programmable nuclease (e.g., SEQ ID NO: 11) may exhibit catalytic activity after heating the composition to a temperature of greater than 45° C. and restoring the temperature to a temperature of from 25° C. to 45° C.

Allele Specific PCR Amplification

Amplification methods can also enhance the assay detection of the target nucleic acid, such as enhancing a method of assaying for a target nucleic acid in a sample, comprises: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. For example, amplification is performed using allele-specific PCR. Allele-specific PCR comprises using a common reverse primer and two forward allele-specific primers with different 3' ends to amplify the two allele-specific PCR products of different lengths. Often the forward primer for the segment of the target nucleic acid comprises the mutation at the 3' end of the primer and the forward primer for the nucleic acid comprising at least 50% sequence identity segment of the to the target nucleic acid comprises a variant of the mutation at the 3' end of the primer. The 3' end can cause a mismatch that will result in the primer not functioning as a primer under appropriate conditions. This allows for the choosing of conditions that allow for the amplification of the segment of the target nucleic acid but not the nucleic acid comprising at least 50% sequence identity to the segment of the target nucleic acid. Often, the products from the two different forward primers are also different lengths, so these two products can be separated based on their differing lengths using techniques, such as agarose gel electrophoresis. Therefore, the segment of the target nucleic can be enriched before the contacting in the method described herein.

Often, allele-specific PCR is combined with COLD-PCR. Sometimes, allele-specific PCR is combined with full COLD-PCR as described above. Sometimes, allele-specific PCR is combined with fast COLD-PCR as described above.

Primer and Guide Nucleic Acid Design for Amplification and Detection

A number of target amplification and detection methods are consistent with the methods, compositions, reagents, enzymes, and kits disclosed herein. The target amplification and detection methods, as described herein, are compatible with the DETECTR assay methods disclosed herein. The target amplification and detection methods, as described herein, are compatible with any of the programmable nucleases disclosed herein (e.g., a programmable nuclease with at least 60% sequence identity to SEQ ID NO: 11) and use of said programmable nuclease in a method of detecting a target nucleic acid. The target amplification and detection methods, as described herein, are compatible with any of the compositions comprising a programmable nuclease and a buffer, which has been developed to improve the function of the programmable nuclease (e.g., a programmable nuclease and a buffer with low salt (about 110 mM or less) and a pH of 7 to 8) and use of said compositions in a method of detecting a target nucleic acid. The target amplification and detection methods, as described herein, are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence. As described herein, a target nucleic acid may be detected using a DNA-activated programmable RNA nuclease (e.g., a Cas13), a DNA-activated programmable DNA nuclease (e.g., a Cas12), or an RNA-activated programmable RNA nuclease (e.g., a Cas13) and other reagents disclosed herein (e.g., RNA components). The target nucleic acid may be detected using DETECTR, as described herein. The target nucleic acid may be an RNA, reverse transcribed RNA, DNA, DNA amplicon, amplified DNA, synthetic nucleic acids, or nucleic acids found in biological or environmental samples. Amplification methods can also enhance the assay detection of the target nucleic acid sequence, such as enhancing a method of assaying for a target nucleic acid in a sample. In some cases, the target nucleic acid is amplified prior to or concurrent with detection. In some cases, the target nucleic acid is reverse transcribed prior to amplification. The target nucleic acid may be amplified via loop mediated isothermal amplification (LAMP) of a target nucleic acid sequence. In some cases, the nucleic acid is amplified using LAMP coupled with reverse transcription (RT-LAMP). The LAMP amplification may be performed independently, or the LAMP amplification may be coupled to DETECTR for detection of the target nucleic acid. The RT-LAMP amplification may be performed independently, or the RT-LAMP amplification may be coupled to DETECTR for detection of the target nucleic acid. The DETECTR reaction may be performed using any method consistent with the methods disclosed herein.

Amplification and Detection Reaction Mixtures

In some embodiments, a LAMP amplification reaction comprises a plurality of primers, dNTPs, and a DNA polymerase. LAMP may be used to amplify DNA with high specificity under isothermal conditions. The DNA may be single stranded DNA or double stranded DNA. In some cases, a target nucleic acid comprising RNA may be reverse transcribed into DNA using a reverse transcriptase prior to LAMP amplification. A reverse transcription reaction may comprise primers, dNTPs, and a reverse transcriptase. In some cases, the reverse transcription reaction and the LAMP amplification reaction may be performed in the same reaction. A combined RT-LAMP reaction may comprise LAMP primers, reverse transcription primers, dNTPs, a reverse transcriptase, and a DNA polymerase. In some case, the LAMP primers may comprise the reverse transcription primers. In some embodiments, the dNTPs may comprise dTTP, dATP, dGTP, and dCTP. In some embodiments, the dNTPs may comprise dUTP, dATP, dGTP, and dCTP.

A target nucleic acid may be reverse transcribed prior to or concurrent with amplification. For example, an RNA target nucleic acid may be reverse transcribed into DNA. A reverse transcription reaction may comprise an RNA target nucleic acid, dNTPs, and a reverse transcriptase. In some embodiments, the dNTPs may comprise dTTP, dATP, dGTP, and dCTP. In some embodiments, the dNTPs may comprise dUTP, dATP, dGTP, and dCTP. Reverse transcription may be performed in the same reaction as LAMP amplification as a reverse transcription LAMP (RT-LAMP reaction). An amplified target nucleic acid may be transcribed using in vitro transcription (IVT) concurrent with or subsequent to amplification. The amplification may be LAMP, or the amplification may be RT-LAMP. An IVT reaction may comprise an amplified target nucleic acid, NTPs, and an RNA polymerase. In some embodiments, the amplified target nucleic acid comprises dU nucleic acids.

In some embodiments, an amplification reaction comprises an uracil-DNA glycosylase (UDG) enzyme. The UDG enzyme may be heat-activated (e.g., at about 50° C.) to degrade any nucleic acid containing dU in the sample. For example, the heat-activated UDG enzyme may degrade contaminating DNA containing dU. The UDG enzyme may be heat-inactivated (e.g., at 95° C.) after degradation of the nucleic acid containing dU and prior to amplification of the target nucleic acid. For example, the heat-inactivated UDG enzyme may be inactivated prior to amplifying a target nucleic acid sequence using dNTPs comprising dUTP. An active UDG enzyme may be added to an amplification reaction prior to amplification to degrade contaminating nucleic acids containing dU. In some embodiments, the UDG enzyme is removed prior to amplification of the target nucleic acid. The UDG enzyme may also be present in an inactive state during amplification of the target nucleic acid using dUTPs. In some embodiments, active UDG enzyme is present in an amplification reaction using dNTPs that do not comprise dUTP.

A DETECTR reaction to detect the target nucleic acid sequence may comprise a guide nucleic acid comprising a segment that is reverse complementary to a segment of the target nucleic acid and a programmable nuclease. The programmable nuclease when activated, as described elsewhere herein, exhibits sequence-independent cleavage of a reporter (e.g., a nucleic acid comprising a moiety that becomes detectable upon cleavage of the nucleic acid by the programmable nuclease). The programmable nuclease is activated upon the guide nucleic acid hybridizing to the target nucleic acid. In some embodiments, the target nucleic acid comprises dU nucleic acids. A combined LAMP DETECTR reaction may comprise a plurality of primers, dNTPs, a DNA polymerase, a guide nucleic acid, a programmable nuclease, and a substrate nucleic acid. A combined RT-LAMP DETECTR reaction may comprise LAMP primers, reverse transcription primers, dNTPs, a reverse transcriptase, a DNA polymerase, a guide nucleic acid, a programmable nuclease, and a substrate nucleic acid. In some case, the LAMP primers may comprise the reverse transcription primers. LAMP and DETECTR can be carried out in the same sample volume. LAMP and DETECTR can be carried out concurrently in separate sample volumes or in the same sample volume. RT-LAMP and DETECTR can be carried out in the same sample volume. RT-LAMP and DETECTR can be carried out concurrently in separate sample volumes or in the same sample volume.

Primer Design for LAMP Amplification

A LAMP reaction may comprise a plurality of primers. A plurality of primers are designed to amplify a target nucleic acid sequence, which is shown in FIG. 40 relative to various regions of a double stranded nucleic acid. The primers can anneal to or have sequences corresponding to these various regions. As shown in FIG. 40, the F1c region is 5' of the F2c region, and the F2c region is 5' of the F3c region. Additionally, the B1 region is 3' of the B2 region, and the B2 region is 3' of the B3 region. The F3c, F2c, F1c, B1, B2, and B3 regions are shown on the lower strand in FIG. 40. An F3 region is a sequence reverse complementary to the F3c region. An F2 region is a sequence reverse complementary to the F2c region. An F1 region is a sequence reverse complementary to the F1c region. The B1c region is a sequence reverse complementary to a B1 region. The B2c region is a sequence reverse complementary to a B2 region. The B3c region is a sequence reverse complementary to a B3 region. The target nucleic acid may be 5' of the F1c region and 3' of the B1 region, as shown in the top configuration of FIG. 40. The target nucleic acid may be 5' of the B1c region and 3' of the F1 region, as shown in the bottom configuration of FIG. 40. In some embodiments, the target nucleic acid may be 5' of the F2c region and 3' of the F1c region. In some embodiments, the target nucleic acid may be 5' of the B2c region and 3' of the B1c region. In some embodiments, the target nucleic acid sequence may be 5' of the B1 region and 3' of the B2 region. In some embodiments, the target nucleic acid sequence may be 5' of the F1 region and 3' of the F2 region.

FIG. 40 also shows the structure and directionality of the various primers. The forward outer primer has a sequence of the F3 region. Thus, the forward outer primer anneals to the F3c region. The backward outer primer has a sequence of the B3 region. Thus, the backward outer primer anneals to the B3c region. The forward inner primer has a sequence of the F1c region 5' of a sequence of the F2 region. Thus, the F2 region of the forward inner primer anneals to the F2c region and the amplified sequence forms a loop held together via hybridization of the sequence of the F1c region in the forward inner primer and the F1. The backward inner primer has a sequence of a B1c region 5' of a sequence of the B2 region. Thus, the B2 region of the backward inner primer anneals to the B2c region and the amplified sequence forms a loop held together via hybridization of the sequence of the B1c region of the backward inner primer and the B1 region.

Further, as shown in FIG. 40, the plurality of primers may additionally include a loop forward primer (LF) and/or a loop backward primer (LB). LF is positioned 3' of the F1c region and 5' of the F2c region. LB is positioned 5' of the B2c region and 3' of the B1c region. The F1, F1c, F2, F2c, F3, F3c, B1, B1c, B2, B2c, B3, and/or B3c regions are illustrated in various arrangements relative to the target nucleic acid, the PAM, and the guide RNA (gRNA), as shown in any one of FIG. 40-FIG. 42 or FIG. 50-FIG. 51. The target nucleic acid may be within the nucleic acid strand comprising the B1, B2, B3, LF, F1c, F2c, F3c, and LBc regions. The target nucleic acid may be within the nucleic acid strand comprising the F1, F2, F3, LB, B1c, B2c, B3c, and LFc regions.

A set of LAMP primers may be designed for use in combination with a DETECTR reaction. The nucleic acid may comprise a region (e.g., a target nucleic acid), to which a guide RNA hybridizes. All or part of the guide RNA sequence may be reverse complementary to all or part of the target sequence. The target nucleic acid sequence may be adjacent to a protospacer adjacent motif (PAM) 3' of the target nucleic acid sequence. The PAM may promote interaction the programmable nuclease with the target nucleic acid. A PAM may adjacent to a DNA target nucleic acid sequence. The target nucleic acid sequence may be adjacent to a protospacer flanking site (PFS) 3' of the target nucleic acid sequence. The PFS may promote interaction the programmable nuclease with the target nucleic acid. A PFS may be adjacent to an RNA target nucleic acid sequence. One or more of the guide RNA, the PAM or PFS, or the target nucleic acid sequence may be specifically positioned with respect to one or more of the F1, F1c, F2, F2c, F3, F3c, LF, LFc, LB, LBc, B1, B1c, B2, B2c, B3, and/or B3c regions.

In some cases, the guide RNA is reverse complementary to a sequence of the target nucleic acid, which is between an F1c region and a B1 region, as in FIG. 41A. In some cases, the guide RNA is reverse complementary to a sequence of the target nucleic acid, which is between a B1c region and an F1 region.

In some cases, the guide RNA is partially reverse complementary to a sequence of the target nucleic acid, which is between an F1c region and a B1 region, as in FIG. 41B. In some cases, the guide RNA is partially reverse complementary to a sequence of the target nucleic acid, which is between a B1c region and an F1 region. For example, the target nucleic acid comprises a sequence between an F1c region and a B1 region or a B1c region and an F1 region that is reverse complementary to at least 60% of a guide nucleic acid. In another example, the target nucleic acid comprises a sequence between an F1c region and a B1 region that is reverse complementary to at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 100%, from 5% to 100%, from 5% to 10%, from 10% to 15%, from 15% to 20%, from 20% to 25%, from 25% to 30%, from 30% to 35%, from 35% to 40%, from 40% to 45%, from 45% to 50%, from 50% to 55%, from 55% to 60%, from 60% to 65%, from 65% to 70%, from 70% to 75%, from 75% to 80%, from 80% to 85%, from 85% to 90%, from 90% to 95%, or from 95% to 100% of a guide nucleic acid. In this arrangement, the guide RNA is not reverse complementary to the forward inner primer or the backward inner primer shown in FIG. 40.

In some cases, the guide RNA is reverse complementary to no more than 50%, no more than 40%, no more than 35%, no more than 30%, no more than 25%, no more than 20%, no more than 15%, no more than 10%, or no more than 5% of the forward inner primer, the backward inner primer, or a combination thereof the sequence between the F1c region and the B1 region or the sequence between the B1c region and the F1 region is at least 50%, at least 70%, at least 75%, at least 80%, at least 85%, at least 90%, at least 92%, at least 95%, at least 99%, or 100% reverse complementary to the guide nucleic acid sequence. In some cases, the guide nucleic acid has a sequence reverse complementary to no more than 50%, no more than 40%, no more than 35%, no more than 30%, no more than 25%, no more than 20%, no more than 15%, no more than 10%, or no more than 5% of the forward inner primer, the backward inner primer, the forward outer primer, the backward outer primer, or any combination thereof. In some cases, the guide nucleic acid sequence has a sequence reverse complementary to no more than 50%, no more than 40%, no more than 35%, no more than 30%, no more than 25%, no more than 20%, no more than 15%, no more than 10%, or no more than 5% of a sequence of an F3c region, an F2c region, the F1c region, the B1c region, an B2c region, an B3c region, or any combination thereof. In some embodiments, a sequence of the primer and a sequence of the guide nucleic acid overlap by 50% or less. In some embodiments, a sequence of the primer and a sequence of the guide nucleic acid do not overlap. In some embodiments, the primer is a forward primer, a reverse primer, a forward inner primer, or a reverse inner primer.

In some cases, the region corresponding to the guide RNA sequence does not overlap or hybridize to any of the primers and may further not overlap with or hybridize to any of the regions shown in FIG. 40-FIG. 42 and FIG. 50-FIG. 51.

In some cases, all or a portion of the guide nucleic acid is reverse complementary to a sequence of the target nucleic acid in a loop region. For example, all or a portion of the sequence of the target nucleic acid that hybridizes to the gRNA may be located between the B1 and B2 regions, as shown in FIG. 41C. In another example, all or a portion of the sequence of the target nucleic acid that hybridizes to the gRNA may be located between the F2c and F1c regions, as shown in FIG. 41D. In some cases, all or a portion of the sequence of the target nucleic acid that hybridizes to the gRNA may be located between the F1 and F2 regions. In some cases, all or a portion of the sequence of the target nucleic acid that hybridizes to the gRNA may be located between the B2c and B1c regions.

In some cases, a LAMP primer set may be designed using a commercially available primer design software. A LAMP primer set may be designed for use in combination with a DETECR reaction, a reverse transcription reaction, or both. In some cases, a LAMP primer set may be designed using distributed ledger technology (DLT), artificial intelligence (AI), extended reality (XR) and quantum computing, commonly called "DARQ." In some cases, a LAMP primer set may be designed using quenching of unincorporated amplification signal reporters (QUASR) (Ball et al., Anal Chem. 2016 Apr. 5; 88(7):3562-8. doi: 10.1021/acs.analchem.5b04054. Epub 2016 Mar. 24.). These methods of designing a set of LAMP primers are provided by way of example only; other methods of designing a set of LAMP primers may be readily apparent to one skilled in the art and may be employed in any of the compositions, kits and methods described herein. Exemplary sets of LAMP primers for use in a combined RT-LAMP DETECTR reaction or LAMP-DETECTR to detect the presence of a nucleic acid sequence corresponding to a respiratory syncytial virus (RSV), an influenza A virus (IAV), an influenza B virus (IAV), or a HERC2 SNP are provided in TABLE 5.

TABLE 5

Exemplary LAMP Primers

| SEQ ID NO: | Primer Name | Primer Set | Sequence |
|---|---|---|---|
| SEQ ID NO: 138 | F3 RSV-A-set13 | #1 | TGGAACAAGTTGTGGAGG |
| SEQ ID NO: 139 | B3 RSV-A-set13 | #1 | TGCAGCATCATATAGATCTTGA |
| SEQ ID NO: 140 | FIP RSV-A-set13 | #1 | TAGTGATGCTTTTGGGTTGTTCAATTGTATGAGTATGCTCAAAAATTGG |
| SEQ ID NO: 141 | BIP RSV-A-set13 | #1 | GTGTAGTATTGGGCAATGCTGCTCCTTGGTGTACCTCTGT |
| SEQ ID NO: 142 | LF RSV-A-set13 | #1 | TATGGTAGAATCCTGCTTCTCC |
| SEQ ID NO: 143 | LB RSV-A-set13 | #1 | TGGCCTAGGCATAATGGGAGA |
| SEQ ID NO: 144 | F3 RSV-A-set14 | #2 | AACAAGTTGTGGAGGTGTA |
| SEQ ID NO: 145 | B3 RSV-A-set14 | #2 | CCATTTTCTTTGAGTTGTTCAG |
| SEQ ID NO: 146 | FIP RSV-A-set14 | #2 | TAGTGATGCTTTTGGGTTGTTCAAGAGTATGCTCAAAAATTGGGTG |
| SEQ ID NO: 147 | BIP RSV-A-set14 | #2 | GTATTGGGCAATGCTGCTGGCATATAGATCTTGATTCCTTGGTG |
| SEQ ID NO: 148 | LF RSV-A-set14 | #2 | ATATGGTAGAATCCTGCTTCTC |
| SEQ ID NO: 149 | LB RSV-A-set14 | #2 | CCTAGGCATAATGGGAGAATAC |
| SEQ ID NO: 144 | F3 RSV-A-set15 | #3 | AACAAGTTGTGGAGGTGTA |
| SEQ ID NO: 145 | B3 RSV-A-set15 | #3 | CCATTTTCTTTGAGTTGTTCAG |
| SEQ ID NO: 150 | FIP RSV-A-set15 | #3 | ATAGTGATGCTTTTGGGTTGTTCAAGTATGCTCAAAAATTGGGTG |
| SEQ ID NO: 151 | BIP RSV-A-set15 | #3 | GCTGCTGGCCTAGGCATAATGCATCATATAGATCTTGATTCCTT |
| SEQ ID NO: 406 | LF RSV-A-set15 | #3 | TATATGGTAGAATCCTGCTTCTC |
| SEQ ID NO: 152 | LB RSV-A-set15 | #3 | GGGAGAATACAGAGGTACAC |
| SEQ ID NO: 153 | F3 RSV-A-set16 | #4 | GGGTCTTAGCAAAATCAGTT |
| SEQ ID NO: 139 | B3 RSV-A-set16 | #4 | TGCAGCATCATATAGATCTTGA |
| SEQ ID NO: 154 | FIP RSV-A-set16 | #4 | GAATCCTGCTTCTCCACCCAATTGACACGCTAGTGTACAAGC |
| SEQ ID NO: 141 | BIP RSV-A-set16 | #4 | GTGTAGTATTGGGCAATGCTGCTCCTTGGTGTACCTCTGT |
| SEQ ID NO: 155 | LF RSV-A-set16 | #4 | CCTCCACAACTTGTTCCATTTCT |
| SEQ ID NO: 156 | LB RSV-A-set16 | #4 | TGGCCTAGGCATAATGGGAG |
| SEQ ID NO: 157 | F3 RSV-A-set17 | #5 | AAGCAGAAATGGAACAAGTT |
| SEQ ID NO: 145 | B3 RSV-A-set17 | #5 | CCATTTTCTTTGAGTTGTTCAG |
| SEQ ID NO: 158 | FIP RSV-A-set17 | #5 | TAGTGATGCTTTTGGGTTGTTCAGTGGAGGTGTATGAGTATGC |
| SEQ ID NO: 159 | BIP RSV-A-set17 | #5 | GTAGTATTGGGCAATGCTGCTGATATAGATCTTGATTCCTTGGTG |
| SEQ ID NO: 160 | LF RSV-A-set17 | #5 | TGCTTCTCCACCCAATTTTTGA |
| SEQ ID NO: 161 | LB RSV-A-set17 | #5 | GCCTAGGCATAATGGGAGAATAC |
| SEQ ID NO: 153 | F3 RSV-A-set18 | #6 | GGGTCTTAGCAAAATCAGTT |
| SEQ ID NO: 139 | B3 RSV-A-set18 | #6 | TGCAGCATCATATAGATCTTGA |
| SEQ ID NO: 162 | FIP RSV-A-set18 | #6 | GAATCCTGCTTCTCCACCCAGACACGCTAGTGTACAAGC |
| SEQ ID NO: 141 | BIP RSV-A-set18 | #6 | GTGTAGTATTGGGCAATGCTGCTCCTTGGTGTACCTCTGT |
| SEQ ID NO: 155 | LF RSV-A-set18 | #6 | CCTCCACAACTTGTTCCATTTCT |
| SEQ ID NO: 156 | LB RSV-A-set18 | #6 | TGGCCTAGGCATAATGGGAG |
| SEQ ID NO: 163 | F3 RSV-A-set19 | #7 | TACACAGCTGCTGTTCAA |
| SEQ ID NO: 164 | B3 RSV-A-set19 | #7 | GGTAAATTTGCTGGGCATT |

TABLE 5-continued

Exemplary LAMP Primers

| SEQ ID NO: | Primer Name | Primer Set | Sequence |
| --- | --- | --- | --- |
| SEQ ID NO: 165 | FIP RSV-A-set19 | #7 | TTGGAACATGGGCACCCATAAATGTCCTAGAAAAAGACGATG |
| SEQ ID NO: 166 | BIP RSV-A-set19 | #7 | CTAGTGAAACAAATATCCACACCCAGCACTGCACTTCTTGAGTT |
| SEQ ID NO: 167 | LF RSV-A-set19 | #7 | TTGTAAGTGATGCAGGAT |
| SEQ ID NO: 168 | LB RSV-A-set19 | #7 | AGGGACCCTCATTAAGAGTCATG |
| SEQ ID NO: 169 | F3 RSV-A-set20 | #8 | ATACACAGCTGCTGTTCA |
| SEQ ID NO: 164 | B3 RSV-A-set20 | #8 | GGTAAATTTGCTGGGCATT |
| SEQ ID NO: 170 | FIP RSV-A-set20 | #8 | TCTGCTGGCATGGATGATTGAATGTCCTAGAAAAAGACGATG |
| SEQ ID NO: 166 | BIP RSV-A-set20 | #8 | CTAGTGAAACAAATATCCACACCCAGCACTGCACTTCTTGAGTT |
| SEQ ID NO: 171 | LF RSV-A-set20 | #8 | CCCATATTGTAAGTGATGCAGGAT |
| SEQ ID NO: 172 | LB RSV-A-set20 | #8 | AGGGACCCTCATTAAGAGTCAT |
| SEQ ID NO: 169 | F3 RSV-A-set21 | #9 | ATACACAGCTGCTGTTCA |
| SEQ ID NO: 173 | B3 RSV-A-set21 | #9 | TGGTAAATTTGCTGGGCAT |
| SEQ ID NO: 170 | FIP RSV-A-set21 | #9 | TCTGCTGGCATGGATGATTGAATGTCCTAGAAAAAGACGATG |
| SEQ ID NO: 174 | BIP RSV-A-set21 | #9 | TGAAACAAATATCCACACCCAAGGGCACTGCACTTCTTGAGTT |
| SEQ ID NO: 175 | LF RSV-A-set21 | #9 | CCATATTGTAAGTGATGCAGGAT |
| SEQ ID NO: 176 | LB RSV-A-set21 | #9 | GACCCTCATTAAGAGTCATGAT |
| SEQ ID NO: 177 | F3 RSV-A-set22 | #10 | AACATACGTGAACAAACTTCA |
| SEQ ID NO: 178 | B3 RSV-A-set22 | #10 | GCACATATGGTAAATTTGCTGG |
| SEQ ID NO: 179 | FIP RSV-A-set22 | #10 | ACCCATATTGTAAGTGATGCAGGATAGGGCTCCACATACACAG |
| SEQ ID NO: 180 | BIP RSV-A-set22 | #10 | CTAGTGAAACAAATATCCACACCCAAGCACTGCACTTCTTGAG |
| SEQ ID NO: 181 | LF RSV-A-set22 | #10 | TTTCTAGGACATTGTATTGAACAGC |
| SEQ ID NO: 182 | LB RSV-A-set22 | #10 | GGGACCCTCATTAAGAGTCATG |
| SEQ ID NO: 183 | IAV-MP-F3 | #1 | GACTTGAAGATGTCTTTGC |
| SEQ ID NO: 184 | IAV-MP B3 | #1 | TGTTGTTTGGGTCCCCATT |
| SEQ ID NO: 185 | IAV-MP-FIP | #1 | TTAGTCAGAGGTGACAGGATTGCAGATCTTGAGGCTCTC |
| SEQ ID NO: 186 | IAV-MP-BIP | #1 | TTGTGTTCACGCTCACCGTGTTTGGACAAAGCGTCTACG |
| SEQ ID NO: 187 | IAV-MP FL | #1 | GTCTTGTCTTTAGCCA |
| SEQ ID NO: 188 | IAV-MP BL | #1 | CAGTGAGCGAGGACTG |
| SEQ ID NO: 189 | IAV F3 v2 | #2 | ACCGAGGTCGAAACGT |
| SEQ ID NO: 190 | IAV B3 v2 | #2 | GGTCCCCATTCCCATTG |
| SEQ ID NO: 191 | IAV FIP v2 | #2 | CAAAGACATCTTCAAGTCTCTGCGTTTTTCTCTCTATCGTCCCGTCA |
| SEQ ID NO: 192 | IAV BIP v2 | #2 | AATGGCTAAAGACAAGACCAATCCTTTTTGTCTACGCTGCAGTCC |
| SEQ ID NO: 193 | IAV LF v2 | #2 | CGATCTCGGCTTTGAGGG |
| SEQ ID NO: 194 | IAV LB v2 | #2 | TCACCGTGCCCAGTGAG |
| SEQ ID NO: 195 | IAV F3 v3 | #3 | CGAAAGCAGGTAGATATTGAAAG |
| SEQ ID NO: 196 | IAV B3 v3 | #3 | TCTACGCTGCAGTCCTC |
| SEQ ID NO: 197 | IAV FIP v3 | #3 | TCAAGTCTCTGCGCGATCTCTTTTTTGAGTCTTCTAACCGAGGT |

TABLE 5-continued

Exemplary LAMP Primers

| SEQ ID NO: | Primer Name | Primer Set | Sequence |
|---|---|---|---|
| SEQ ID NO: 198 | IAV BIP v3 | #3 | AGATGTCTTTGCAGGGAAAAACACTTTTTTCACAAATCCTAAAATCCCCTTAG |
| SEQ ID NO: 199 | IAV LF v3 | #3 | GACGATAGAGAGAACGTACGTTTC |
| SEQ ID NO: 200 | IAV LB v3 | #3 | AAGACCAATCCTGTCACCTCT |
| SEQ ID NO: 201 | IAV-set4-F3 | #4 | GCGAAAGCAGGTAGATATTGA |
| SEQ ID NO: 202 | IAV-set4-B3 | #4 | CATTCCCATTGAGGGCATT |
| SEQ ID NO: 203 | IAV-set4-FIP | #4 | CTTCAAGTCTCTGCGCGATCTATGAGTCTTCTAACCGAGGT |
| SEQ ID NO: 204 | IAV-set4-BIP | #4 | TTGAGGCTCTCATGGAATGGCAGCGTGAACACAAATCCTAA |
| SEQ ID NO: 205 | IAV-set4-LF | #4 | TGACGGGACGATAGAGAGAA |
| SEQ ID NO: 206 | IAV-set4-LB | #4 | ACAAGACCAATCCTGTCACC |
| SEQ ID NO: 201 | IAV-set5-F3 | #5 | GCGAAAGCAGGTAGATATTGA |
| SEQ ID NO: 202 | IAV-set5-B3 | #5 | CATTCCCATTGAGGGCATT |
| SEQ ID NO: 207 | IAV-set5-FIP | #5 | TTCAAGTCTCTGCGCGATCTCATGAGTCTTCTAACCGAGGT |
| SEQ ID NO: 204 | IAV-set5-BIP | #5 | TTGAGGCTCTCATGGAATGGCAGCGTGAACACAAATCCTAA |
| SEQ ID NO: 205 | IAV-set5-LF | #5 | TGACGGGACGATAGAGAGAA |
| SEQ ID NO: 206 | IAV-set5-LB | #5 | ACAAGACCAATCCTGTCACC |
| SEQ ID NO: 201 | IAV-set6-F3 | #6 | GCGAAAGCAGGTAGATATTGA |
| SEQ ID NO: 208 | IAV-set6-B3 | #6 | TTGGACAAAGCGTCTACG |
| SEQ ID NO: 203 | IAV-set6-FIP | #6 | CTTCAAGTCTCTGCGCGATCTATGAGTCTTCTAACCGAGGT |
| SEQ ID NO: 204 | IAV-set6-BIP | #6 | TTGAGGCTCTCATGGAATGGCAGCGTGAACACAAATCCTAA |
| SEQ ID NO: 205 | IAV-set6-LF | #6 | TGACGGGACGATAGAGAGAA |
| SEQ ID NO: 206 | IAV-set6-LB | #6 | ACAAGACCAATCCTGTCACC |
| SEQ ID NO: 201 | IAV-set7-F3 | #7 | GCGAAAGCAGGTAGATATTGA |
| SEQ ID NO: 202 | IAV-set7-B3 | #7 | CATTCCCATTGAGGGCATT |
| SEQ ID NO: 209 | IAV-set7-FIP | #7 | AAGTCTCTGCGCGATCTCGATGAGTCTTCTAACCGAGGT |
| SEQ ID NO: 204 | IAV-set7-BIP | #7 | TTGAGGCTCTCATGGAATGGCAGCGTGAACACAAATCCTAA |
| SEQ ID NO: 205 | IAV-set7-LF | #7 | TGACGGGACGATAGAGAGAA |
| SEQ ID NO: 206 | IAV-set7-LB | #7 | ACAAGACCAATCCTGTCACC |
| SEQ ID NO: 210 | IAV-set8-F3 | #8 | TCTTCTAACCGAGGTCGAA |
| SEQ ID NO: 211 | IAV-set8-B3 | #8 | CTGCTCTGTCCATGTTGTT |
| SEQ ID NO: 212 | IAV-set8-FIP | #8 | TCAGAGGTGACAGGATTGGTCTGAAGATGTCTTTGCAGGGAA |
| SEQ ID NO: 213 | IAV-set8-BIP | #8 | TTGTGTTCACGCTCACCGTCATTCCCATTGAGGGCATT |
| SEQ ID NO: 214 | IAV-set8-LF | #8 | ATTCCATGAGAGCCTCAAGATC |
| SEQ ID NO: 215 | IAV-set8-LB | #8 | GAGGACTGCAGCGTAGAC |
| SEQ ID NO: 216 | IAV-set9-F3 | #9 | TTCTCTCTATCGTCCCGTC |
| SEQ ID NO: 211 | IAV-set9-B3 | #9 | CTGCTCTGTCCATGTTGTT |
| SEQ ID NO: 217 | IAV-set9-FIP | #9 | CCCTTAGTCAGAGGTGACAGGAACACAGATCTTGAGGCTCT |
| SEQ ID NO: 213 | IAV-set9-BIP | #9 | TTGTGTTCACGCTCACCGTCATTCCCATTGAGGGCATT |
| SEQ ID NO: 218 | IAV-set9-LF | #9 | GGTCTTGTCTTTAGCCATTCCA |

TABLE 5-continued

Exemplary LAMP Primers

| SEQ ID NO: | Primer Name | Primer Set | Sequence |
|---|---|---|---|
| SEQ ID NO: 215 | IAV-set9-LB | #9 | GAGGACTGCAGCGTAGAC |
| SEQ ID NO: 219 | IAV-set10-F3 | #10 | GTCTTCTAACCGAGGTCGA |
| SEQ ID NO: 211 | IAV-set10-B3 | #10 | CTGCTCTGTCCATGTTGTT |
| SEQ ID NO: 220 | IAV-set10-FIP | #10 | GAGGTGACAGGATTGGTCTTGTTGAAGATGTCTTTGCAGGG |
| SEQ ID NO: 213 | IAV-set10-BIP | #10 | TTGTGTTCACGCTCACCGTCATTCCCATTGAGGGCATT |
| SEQ ID NO: 214 | IAV-set10-LF | #10 | ATTCCATGAGAGCCTCAAGATC |
| SEQ ID NO: 215 | IAV-set10-LB | #10 | GAGGACTGCAGCGTAGAC |
| SEQ ID NO: 221 | IAV-set11-F3 | #11 | AAGAAGACAAGAGATATGGC |
| SEQ ID NO: 222 | IAV-set11-B3 | #11 | CAATTCGACACTAATTGATGGC |
| SEQ ID NO: 223 | IAV-set11-FIP | #11 | GTCTCCTTGCCCAATTAGCAAGCATCAATGAACTGAGCA |
| SEQ ID NO: 224 | IAV-set11-BIP | #11 | GTGGTGTTGGTAATGAAACGAAGCTGTCTGGCTGTCAGTA |
| SEQ ID NO: 225 | IAV-set11-LF | #11 | ACATTAGCCTTCTCTCCTTT |
| SEQ ID NO: 226 | IAV-set11-LB | #11 | AACGGGACTCTAGCATACT |
| SEQ ID NO: 227 | M605 F3 IBV LAMP | IBV | AGGGACATGAACAACAAAGA |
| SEQ ID NO: 228 | M606 B3 IBV LAMP | IBV | CAAGTTTAGCAACAAGCCT |
| SEQ ID NO: 229 | M607 FIP IBV LAMP | IBV | TCAGGGACAATACATTACGCATATCGATAAAGGAGGAAGTAAACACTCA |
| SEQ ID NO: 230 | M608 BIP IBV LAMP | IBV | TAAACGGAACATTCCTCAAACACCACTCTGGTCATATGCATTC |
| SEQ ID NO: 231 | M609 LF IBV LAMP | IBV | TCAAACGGAACTTCCCTTCTTTC |
| SEQ ID NO: 232 | M610 LB IBV LAMP | IBV | GGATACAAGTCCTTATCAACTCTGC |
| SEQ ID NO: 233 | M948 F3 HERC2 set3 | HERC2 | CTTGTAATCAACATCAGGGTAA |
| SEQ ID NO: 234 | M949 B3 HERC2 set3 | HERC2 | AGAAACGACAAGTAGACCATT |
| SEQ ID NO: 235 | M950 FIP HERC2 set3 | HERC2 | CGCCTCTTGGATCAGACACATGTGTTAATACAAAGGTACAGGA |
| SEQ ID NO: 236 | M951 BIP HERC2 set3 | HERC2 | CACGCTATCATCATCAGGGGCTGCTTCAAGTGTATATAAACTCAC |
| SEQ ID NO: 237 | M952 LF HERC2 set3 | HERC2 | GAGAGCCATGAAGAACAAATTCT |
| SEQ ID NO: 238 | M953 LB HERC2 set3 | HERC2 | CGAGGCTTCTCTTTGTTTTTAAT |

A set of LAMP primers may be designed to introduce a PAM sequence into a target nucleic acid sequence that lacks a PAM sequence. The FIP primer may contain a PAM sequence that is not present in the target nucleic acid. The BIP primer may contain a PAM sequence that is not present in the target nucleic acid. The FIP primer may contain a sequence that is reverse complementary to a PAM sequence that is not present in the target nucleic acid. The BIP primer may contain a sequence that is reverse complementary to a PAM sequence that is not present in the target nucleic acid. The PAM sequence or the sequence complementary to the PAM sequence may be located within the FIP primer or the BIP primer at a distance in bases from the 5' end of the primer. For example, the PAM sequence may be located 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 bases from 5' end of the primer. In some embodiments, the PAM sequence may be located from 0 to 10, from 5 to 15, from 10 to 20, from 15 to 25, from 20 to 30, from 25 to 35, from 30 to 40 bases from 5' end of the primer.

A set of LAMP primers may be designed for use in combination with a DETECTR reaction to detect a single nucleotide polymorphism (SNP) in a target nucleic acid. In some embodiments, a sequence of the target nucleic acid comprising the SNP may be reverse complementary to all or a portion of the guide nucleic acid. For example, the SNP may be positioned within a sequence of the target nucleic acid that is reverse complementary to the guide RNA sequence, as illustrated in FIG. 51C. In some cases, the sequence of the target nucleic acid sequence comprising the SNP does not overlap with or is not reverse complementary to the primers or one or more of the F1, F1c, F2, F2c, F3, F3c, B1, B1c, B2, B2c, B3, B3c, LB, LBc, LF, or LFc regions shown in FIG. 51. The guide nucleic acid may be reverse complementary to a sequence of the target nucleic acid between the F1c and B1 regions, as illustrated in FIG. 51A. The guide nucleic acid may be reverse complementary to a sequence of the target nucleic acid between the B1c and F1 regions. A guide nucleic acid may be partially reverse complementary to a sequence of the target nucleic acid between the F1c region and the B1 region, for example as illustrated in FIG. 51B. A guide nucleic acid may be partially reverse complementary to a sequence of the target nucleic acid between the B1c region and the F1 region. For example, the sequence of the target nucleic acid sequence having the SNP may be reverse complementary to at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 100%, from 5% to 100%, from 5% to 10%, from 10% to 15%, from 15% to 20%, from 20% to 25%, from 25% to 30%, from 30% to 35%, from 35% to 40%, from 40% to 45%, from 45% to 50%, from 50% to 55%, from 55% to 60%, from 60% to 65%, from 65% to 70%, from 70% to 75%, from 75% to 80%, from 80% to 85%, from 85% to 90%, from 90% to 95%, or from 95% to 100% of the guide nucleic acid. In some cases, the guide nucleic acid does not overlap with and/or is not reverse complementary to any of the plurality of primers or the F1, F1c, F2, F2c, F3, F3c, B1, B1c, B2, B2c, B3, B3c, LB, LBc, LF, or LFc regions. Exemplary sets of DETECTR gRNAs for use in a combined RT-LAMP DETECTR or LAMP-DETECTR reaction to detect the presence of a nucleic acid sequence corresponding to a respiratory syncytial virus (RSV), an influenza A virus (IAV), an influenza B virus (IAV), or a HERC2 SNP are provided in TABLE 6.

TABLE 6

Exemplary DETECTR Guide RNAs

| SEQ ID NO: | gRNA Name | Sequence |
|---|---|---|
| SEQ ID NO: 239 | gRNA #1 (R1118) | UAAUUUCUACUAAGU GUAGAUCUUAUAAAA GAACUAGCCAA |
| SEQ ID NO: 240 | gRNA #2 (R288) | UAAUUUCUACUAAGU GUAGAUACUCAAUUU CCUCACUUCUC |
| SEQ ID NO: 241 | R283 | UAAUUUCUACUAAGU GUAGAUUGUUCACGC UCACCGUGCCC |
| SEQ ID NO: 242 | R781 | UAAUUUCUACUAAGU GUAGAUGCCAUUCCA UGAGAGCCUCA |

TABLE 6-continued

Exemplary DETECTR Guide RNAs

| SEQ ID NO: | gRNA Name | Sequence |
|---|---|---|
| SEQ ID NO: 243 | R782 | UAAUUUCUACUAAGU GUAGAUGACAAAGCG UCUACGCUGCA |
| SEQ ID NO: 244 | IBV (R778) | UAAUUUCUACUAAGU GUAGAUCUAACACUC UCAGGGACAAU |
| SEQ ID NO: 245 | A SNP Position 9 (R570) | UAAUUUCUACUAAGU GUAGAUAGCAUUAAA UGUCAAGUUCU |
| SEQ ID NO: 246 | G SNP Position 9 (R571) | UAAUUUCUACUAAGU GUAGAUAGCAUUAAG UGUCAAGUUCU |
| SEQ ID NO: 247 | A SNP Position 14 (R1138) | UAAUUUCUACUAAGU GUAGAUAUUUGAGCA UUAAAUGUCAA |
| SEQ ID NO: 248 | G SNP Position 14 (R1139) | UAAUUUCUACUAAGU GUAGAUAUUUGAGCA UUAAGUGUCAA |

Amplification and Detection of a Single Nucleotide Polymorphism Allele

A DETECTR reaction may be used to detect the presence of a specific single nucleotide polymorphism (SNP) allele in a sample. The DETECTR reaction may produce a detectable signal, as described elsewhere herein, in the presence of a target nucleic acid comprising a specific SNP allele. The DETECTR reaction may not produce a signal in the absence of the target nucleic acid or in the presence of a nucleic acid sequence that does not comprise the specific SNP allele or comprises a different SNP allele. In some cases, a DETECTR reaction may comprise a guide RNA reverse complementary to a portion of a target nucleic acid sequence comprising a specific SNP allele. The guide RNA and the target nucleic acid comprising the specific SNP allele may bind to and activate a programmable nuclease, thereby producing a detectable signal as described elsewhere herein. The guide RNA and a nucleic acid sequence that does not comprise the specific SNP allele may not bind to or activate the programmable nuclease and may not produce a detectable signal. In some cases, a target nucleic acid sequence that may or may not comprise a specific SNP allele may be amplified using, for example, a LAMP amplification reaction. In some cases, the LAMP amplification reaction may be combined with a reverse transcription reaction, a DETECTR reaction, or both. For example, the LAMP reaction may be an RT-LAMP reaction, a LAMP DETECTR reaction, or an RT-LAMP DETECTR reactions.

A method of assaying for a segment of a target nucleic acid may comprise contacting a sample comprising a population of nucleic acids, wherein the population comprises at least one nucleic acid comprising a segment having less than 100% sequence identity to the segment of the target nucleic acid and having no less than 50% sequence identity to the segment of the target nucleic acid to a guide nucleic acid that hybridizes to the segment of the target nucleic acid, a detector nucleic acid, and a Cas12 nuclease (e.g., SEQ ID NO: 1 or SEQ ID NO: 11) that cleaves the detector nucleic acid upon hybridization of the guide nucleic acid to the segment of the target nucleic acid; and assaying for a signal produced by cleavage of the detector nucleic acid, wherein the signal is at least two-fold greater when the segment of the target nucleic acid is present in the sample than the signal when the sample lacks the segment of the target nucleic acid. In some embodiments, the segment of the at least one nucleic acid comprises at least two base mutations compared to the segment of the target nucleic acid. In some embodiments, the segment of the at least one nucleic acid comprises from one to ten base mutations compared to the segment of the target nucleic acid. In some embodiments, the segment of the at least one nucleic acid comprises one base mutation compared to the segment of the target nucleic acid. In some embodiments, the signal produced is from two-fold to 20-fold greater when the segment of the target nucleic acid is present in the sample than the signal when the sample lacks the segment of the target nucleic acid. In some embodiments, the signal produced is from two-fold to 10-fold greater when the segment of the target nucleic acid is present in the sample than the signal when the sample lacks the segment of the target nucleic acid. In some embodiments, the signal produced is from five-fold to 10-fold greater when the segment of the target nucleic acid is present in the sample than the signal when the sample lacks the segment of the target nucleic acid. In some embodiments, the signal produced is from 2 fold to 100 fold greater when the segment of the target nucleic acid is present in the sample than the signal when the sample lacks the segment of the target nucleic acid. In some embodiments, the signal produced is from 2 fold to 5 fold greater when the segment of the target nucleic acid is present in the sample than the signal when the sample lacks the segment of the target nucleic acid. In some embodiments, the signal produced is from 5 fold to 10 fold greater when the segment of the target nucleic acid is present in the sample than the signal when the sample lacks the segment of the target nucleic acid. In some embodiments, the signal produced is from 10 fold to 15 fold greater when the segment of the target nucleic acid is present in the sample than the signal when the sample lacks the segment of the target nucleic acid. In some embodiments, the signal produced is from 15 fold to 20 fold greater when the segment of the target nucleic acid is present in the sample than the signal when the sample lacks the segment of the target nucleic acid. In some embodiments, the signal produced is from 20 fold to 25 fold greater when the segment of the target nucleic acid is present in the sample than the signal when the sample lacks the segment of the target nucleic acid. In some embodiments, the signal produced is from 25 fold to 30 fold greater when the segment of the target nucleic acid is present in the sample than the signal when the sample lacks the segment of the target nucleic acid. In some embodiments, the signal produced is from 30 fold to 35 fold greater when the segment of the target nucleic acid is present in the sample than the signal when the sample lacks the segment of the target nucleic acid. In some embodiments, the signal produced is from 35 fold to 40 fold greater when the segment of the target nucleic acid is present in the sample than the signal when the sample lacks the segment of the target nucleic acid. In some embodiments, the signal produced is from 40 fold to 45 fold greater when the segment of the target nucleic acid is present in the sample than the signal when the sample lacks the segment of the target nucleic acid. In some embodiments, the signal produced is from 45 fold to 50 fold greater when the segment of the target nucleic acid is present in the sample than the signal when the sample lacks the segment of the target nucleic acid. In some embodiments, the signal produced is from 50 fold to 60 fold greater when the segment of the target nucleic acid is present in the sample than the signal when the sample lacks the segment of the target nucleic acid. In some embodiments, the signal produced is from 60 fold to 70 fold greater when the segment of the target nucleic acid is present in the sample than the signal when the sample lacks the segment of the target nucleic acid. In some embodiments, the signal produced is from 70 fold to 80 fold greater when the segment of the target nucleic acid is present in the sample than the signal when the sample lacks the segment of the target nucleic acid. In some embodiments, the signal produced is from 80 fold to 90 fold greater when the segment of the target nucleic acid is present in the sample than the signal when the sample lacks the segment of the target nucleic acid. In some embodiments, the signal produced is from 90 fold to 100 fold greater when the segment of the target nucleic acid is present in the sample than the signal when the sample lacks the segment of the target nucleic acid. In some embodiments, the signal produced is from 100 fold to 200 fold greater when the segment of the target nucleic acid is present in the sample than the signal when the sample lacks the segment of the target nucleic acid. In some embodiments, the signal produced is from 2 fold to 10 fold greater when the segment of the target nucleic acid is present in the sample than the signal when the sample lacks the segment of the target nucleic acid. In some embodiments, the signal produced is from 20 fold to 40 fold greater when the segment of the target nucleic acid is present in the sample than the signal when the sample lacks the segment of the target nucleic acid. In some embodiments, the signal produced is from 2 fold to 50 fold greater when the segment of the target nucleic acid is present in the sample than the signal when the sample lacks the segment of the target nucleic acid. In some embodiments, the signal produced is from 1.5 fold to 100 fold greater when the segment of the target nucleic acid is present in the sample than the signal when the sample lacks the segment of the target nucleic acid. The guide may be reverse complementary to the segment of the target nucleic acid. In some embodiments, the guide nucleic acid and the second guide nucleic acid lack synthetic mismatches. A synthetic mismatch may be an additional mismatch between a target nucleic acid and a guide nucleic acid introduced into the guide nucleic acid to improve the single-base distinction capabilities of a programmable nuclease.

In some embodiments, the DETECTR reaction may be used to detect the presence of a specific SNP allele in a sample, wherein the SNP is located in a target nucleic acid sequence that lacks a PAM sequence. For example, the DETECTR reaction, wherein the target nucleic acid segment lacks a PAM sequence, comprises LAMP amplifying the target nucleic acid segment using a forward inner primer (FIP) or a backward inner primer (BIP) having a region that is reverse complementary to the target nucleic acid segment and a region that has a PAM sequence reverse complement, thereby generating a PAM target nucleic acid having a PAM sequence adjacent to target sequence of an amplification product; contacting the PAM target nucleic acid to PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one nucleic acid of the reporter of a population of nucleic acids of the reporters, wherein the cleavage indicates a presence of the target nucleic acid in the sample and wherein the absence of the cleavage indicates an absence of the target nucleic acid in the sample. The detection of the signal can indicate the presence of the target nucleic acid. Sometimes, the target nucleic acid comprises a mutation. Often, the mutation is a single nucleotide mutation.

The SNP may be positioned at a distance from a PAM sequence. The PAM sequence may be a native PAM sequence, or the PAM sequence may be a generated PAM sequence. The PAM sequence may be generated by amplification. In some embodiments, the SNP may be positioned 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 bases from the PAM sequence. In some embodiments, the SNP may be positioned from 1 to 10, from 5 to 15, from 10 to 20, from 15 to 25, from 20 to 30, from 25 to 35, from 30 to 40 bases from the PAM sequence. The SNP may be positioned on the forward strand. The SNP may be positioned on the reverse strand.

A guide nucleic acid may be specific for an SNP allele. For example, a guide nucleic acid may increase the trans cleavage activity of a programmable nuclease more when contacted to a target nucleic acid comprising a specific SNP allele than when contacted to a target nucleic acid comprising a different SNP allele. In some embodiments, the guide nucleic acid may increase the trans cleavage activity of a programmable nuclease more when contacted to a target nucleic acid comprising an A nucleic acid at a SNP than when contacted to a target nucleic acid comprising a T, a C, or a G nucleic acid at the SNP. In some embodiments, the guide nucleic acid may increase the trans cleavage activity of a programmable nuclease more when contacted to a target nucleic acid comprising a T nucleic acid at a SNP than when contacted to a target nucleic acid comprising an A, a C, or a G nucleic acid at the SNP. In some embodiments, the guide nucleic acid may increase the trans cleavage activity of a programmable nuclease more when contacted to a target nucleic acid comprising a C nucleic acid at a SNP than when contacted to a target nucleic acid comprising an A, a T, or a G nucleic acid at the SNP. In some embodiments, the guide nucleic acid may increase the trans cleavage activity of a programmable nuclease more when contacted to a target nucleic acid comprising a G nucleic acid at a SNP than when contacted to a target nucleic acid comprising an A, a C, or a T nucleic acid at the SNP. In some embodiments, the guide nucleic acid may be specific for a first SNP allele at a first SNP and a second SNP allele at a second SNP site. The programmable nuclease may be a Cas12, a Cas13, or a Cas14.

A DETECTR reaction, as described elsewhere herein, may produce a detectable signal specifically in the presence of a target nucleic acid sequence comprising a specific SNP allele. For example, the DETECTR reaction may produce a detectable signal in the presence of a target nucleic acid comprising a G nucleic acid at a location of a SNP but not in the presence of a nucleic acid comprising a C, a T, or an A nucleic acid at the location of the SNP. The DETECTR reaction may produce a detectable signal in the presence of a target nucleic acid comprising a T nucleic acid at a location of a SNP but not in the presence of a nucleic acid comprising a G, a C, or an A nucleic acid at the location of the SNP. The DETECTR reaction may produce a detectable signal in the presence of a target nucleic acid comprising a C nucleic acid at a location of a SNP but not in the presence of a nucleic acid comprising a G, a T, or an A nucleic acid at the location of the SNP. The DETECTR reaction may produce a detectable signal in the presence of a target nucleic acid comprising an A nucleic acid at a location of a SNP but not in the presence of a nucleic acid comprising a G, a T, or a C nucleic acid at the location of the SNP. In addition to the DETECTR reaction, the target nucleic acid having the SNP may be concurrently, sequentially, concurrently together in a sample, or sequentially together in a sample be carried out alongside LAMP or RT-LAMP. For example, the reactions can comprise LAMP and DETECTR reactions, or RT-LAMP and DETECTR reactions. Performing a DETECTR reaction in combination with a LAMP reaction may result in an increased detectable signal as compared to the DETECTR reaction in the absence of the LAMP reaction.

In some cases, the detectable signal produced in the DETECTR reaction may be higher in the presence of a target nucleic acid comprising a specific SNP allele than in the presence of a nucleic acid that does not comprise the specific SNP allele. In some cases, the DETECTR reaction may produce a detectable signal that is at least 1-fold, at least 2-fold, at least 3-fold, at least 4-fold, at least 5-fold, at least 10-fold, at least 20-fold, at least 30-fold, at least 40-fold, at least 50-fold, at least 100-fold, at least 200-fold, at least 300-fold, at last 400-fold, at least 500-fold, at least 1000-fold, at least 2000-fold, at least 3000-fold, at least 4000-fold, at least 5000-fold, at least 6000-fold, at least 7000-fold, at least 8000-fold, at least 9000-fold, at least 10000-fold, at least 50000-fold, at least 100000-fold, at least 500000-fold, or at least 1000000-fold greater in the presence of a target nucleic acid comprising a specific SNP allele than in the presence of a nucleic acid that does not comprise the specific SNP allele. In some cases, the DETECTR reaction may produce a detectable signal that is from 1-fold to 2-fold, from 2-fold to 3-fold, from 3-fold to 4-fold, from 4-fold to 5-fold, from 5-fold to 10-fold, from 10-fold to 20-fold, from 20-fold to 30-fold, from 30-fold to 40-fold, from 40-fold to 50-fold, from 50-fold to 100-fold, from 100-fold to 500-fold, from 500-fold to 1000-fold, from 1000-fold to 10,000-fold, from 10,000-fold to 100,000-fold, or from 100,000-fold to 1,000,000-fold greater in the presence of a target nucleic acid comprising a specific SNP allele than in the presence of a nucleic acid that does not comprise the specific SNP allele.

A DETECTR reaction may be used to detect the presence of a SNP allele associated with a disease or a condition in a nucleic acid sample. The DETECTR reaction may be used to detect the presence of a SNP allele associated with an increased likelihood of developing a disease or a condition in a nucleic acid sample. The DETECTR reaction may be used to detect the presence of a SNP allele associated with a phenotype in a nucleic acid sample. For example, a DETECTR reaction may be used to detect a SNP allele associated with a disease such as phenylketonuria (PKU), cystic fibrosis, sickle-cell anemia, albinism, Huntington's disease, myotonic dystrophy type 1, hypercholesterolemia, neurofibromatosis, polycystic kidney disease, hemophilia, muscular dystrophy, hypophosphatemic rickets, Rat's syndrome, or spermatogenic failure. A SNP allele associated with a disease may be in a gene such as phenylalanine hydroxylase (PAH) gene, cystic fibrosis transmembrane conductance regulator (CFTR) gene, a β-globin gene, a Huntingtin gene, a dystrophin (DMD) gene, an apolipoprotein B (APOB) gene, a low-density lipoprotein receptor (LDLR) gene, a low-density lipoprotein receptor adaptor protein 1 (LDLRAP1) gene, a proprotein convertase subtilisin/kexin type 9 (PCSK9) gene, a neurofibromin (NF1) gene, a PKD1 gene, an PKD2 gene, a coagulation factor VIII (F8) gene, a coagulation factor IX (F9) gene, a myotonic dystrophy protein kinase (DMPK) gene, a phosphate regulating endopeptidase homolog X-linked (PHEX) gene, or a methyl CpG binding protein 2 (MECP) gene. A DETECTR reaction may be used to detect a SNP allele associated with an increased risk of cancer, for example bladder cancer, brain cancer, breast cancer, cervical cancer, colon cancer, colorectal cancer, gallbladder cancer, stomach cancer, leukemia, liver cancer, lung cancer, oral cancer, esophageal cancer, ovarian cancer, pancreatic cancer, prostate cancer, skin cancer, testicular cancer, thyroid cancer, neuroblastoma, or lymphoma. A DETECTR reaction may be used to detect a SNP allele associated with an increased risk of a disease, for example Alzheimer's disease, Parkinson's disease, amyloidosis, heterochromatosis, celiac disease, macular degeneration, or hypercholesterolemia. A DETECTR reaction may be used to detect a SNP allele associated with a phenotype, for example, eye color, hair color, height, skin color, race, alcohol flush reaction, caffeine consumption, deep sleep, genetic weight, lactose intolerance, muscle composition, saturated fat and weight, or sleep movement.

A target nucleic acid may be amplified prior to detection (e.g., detection using a DETECTR reaction). The target nucleic acid may be amplified using any of the amplification methods or reagents described herein. The DETECTR reaction may comprise detecting the presence of a target nucleic acid comprising a specific SNP allele at a SNP of interest. In some cases, the target nucleic acid comprises a sequence variation that is not of interest near the SNP of interest. The sequence variation may comprise a second SNP, a heterogenous sequence, or a region of low sequence conservation. The sequence variation may be near the SNP of interest. For example, the sequence variation may overlap with an annealing region for a gRNA directed to detect a specific allele of the SNP of interest. In some embodiments, the target nucleic acid may be amplified prior to or concurrent with detection to reduce or remove the sequence variation that is not of interest while preserving the SNP of interest. For example, amplification to remove the sequence variation may be performed using a primer that overlaps with or anneals to a region of the nucleic acid comprising the sequence variation that is not of interest. The primer may not overlap or anneal to the region comprising the SNP of interest. In some cases, the primer overlaps with a region that corresponds to or anneals to the gRNA. Amplification using the primer that overlaps the sequence variation that is not of interest may increase the homogeneity of the nucleic acid sequence at the site of the variation that is not of interest while maintaining the heterogeneity of the nucleic acid at the SNP of interest. For example, amplification may be used to overwrite the sequence variation that is not of interest. In some cases, amplification to increase the homogeneity of the nucleic acid sequence may be used improve species-level detection of a target nucleic acid wherein the gRNA is target to a region of low or imperfect sequence conservation.

Detection/Visualization Devices

A number of detection or visualization devices and methods are consistent with the methods, compositions, reagents, enzymes, and kits disclosed herein for assaying for a signal indicating cleavage of at least some detector nucleic acids of a population of detector nucleic acids. The methods disclosed herein are, for example, consistent with fluidic devices for detection of a signal indicating cleavage of at least some detector nucleic acids of a population of detector nucleic acids, wherein the fluidic device may comprise multiple pumps, valves, reservoirs, and chambers for sample preparation, amplification of a target nucleic acid within the sample, mixing with a programmable nuclease, and detection of a signal indicating cleavage of at least some detector nucleic acids of a population of detector nucleic acids by the programmable nuclease within the fluidic system itself. For example, the fluidic device may comprise an incubation and detection chamber or a stand-alone detection chamber, in which a colorimetric, fluorescence, electrochemical, or electrochemiluminesence signal is generated for detection. The detection can be analyzed using various methods.

As described herein, a target nucleic acid comprising DNA may be detected using a DNA-activated programmable RNA nuclease and other reagents disclosed herein. A DNA-activated programmable RNA nuclease may also be multiplexed as described herein. Sometimes, the signal generated for detection is a calorimetric, potentiometric, amperometric, optical (e.g., fluorescent, colorimetric, etc.), or piezo-electric signal. Often a calorimetric signal is heat produced after cleavage of the nucleic acids of a reporter. Sometimes, a calorimetric signal is heat absorbed after cleavage of the nucleic acids of a reporter. A potentiometric signal, for example, is electrical potential produced after cleavage of the nucleic acids of a reporter. An amperometric signal can be movement of electrons produced after the cleavage of a nucleic acid of a reporter. Often, the signal is an optical signal, such as a colorimetric signal or a fluorescence signal. An optical signal is, for example, a light output produced after the cleavage of the nucleic acids of a reporter. Sometimes, an optical signal is a change in light absorbance between before and after the cleavage of nucleic acids of a reporter. Often, a piezo-electric signal is a change in mass between before and after the cleavage of the nucleic acid of a reporter. Sometimes, the nucleic acid of a reporter is a protein-nucleic acid. Often, the protein-nucleic acid is an enzyme-nucleic acid. The detection/visualization can be analyzed using various methods, as further described below.

The results from the detection region from a completed assay can be detected or visualized and analyzed in various ways. In some cases, the positive control spot and the detection spot in the detection region is visible by eye, and the results can be read by the user. In some cases, the positive control spot and the detection spot in the detection region is visualized by an imaging device. Often, the imaging device is a digital camera, such a digital camera on a mobile device. The mobile device may have a software program or a mobile application that can capture an image of the support medium, identify the assay being performed, detect the detection region and the detection spot, provide image properties of the detection spot, analyze the image properties of the detection spot, and provide a result. Alternatively, or in combination, the imaging device can capture fluorescence, ultraviolet (UV), infrared (IR), or visible wavelength signals. The imaging device may have an excitation source to provide the excitation energy and captures the emitted signals. In some cases, the excitation source can be a camera flash and optionally a filter. In some cases, the imaging device is used together with an imaging box that is placed over the support medium to create a dark room to improve imaging. The imaging box can be a cardboard box that the imaging device can fit into before imaging. In some instances, the imaging box has optical lenses, mirrors, filters, or other optical elements to aid in generating a more focused excitation signal or to capture a more focused emission signal. Often, the imaging box and the imaging device are small, handheld, and portable to facilitate the transport and use of the assay in remote or low resource settings.

The assay described herein can be visualized and analyzed by a mobile application (app) or a software program. Using the graphic user interface (GUI) of the app or program, an individual can take an image of the support medium, including the detection region, barcode, reference color scale, and fiduciary markers on the housing, using a camera on a mobile device. The program or app reads the barcode or identifiable label for the test type, locate the fiduciary marker to orient the sample, and read the detectable signals, compare against the reference color grid, and determine the presence or absence of the target nucleic acid, which indicates the presence of the gene, virus, or the agent responsible for the disease, cancer, or genetic disorder. The mobile application can present the results of the test to the individual. The mobile application can store the test results in the mobile application. The mobile application can communicate with a remote device and transfer the data of the test results. The test results can be viewable remotely from the remote device by another individual, including a healthcare professional. A remote user can access the results and use the information to recommend action for treatment, intervention, clean up of an environment.

The methods for detection of a target nucleic acid described herein further can comprises reagents protease treatment of the sample. The sample can be treated with protease, such as Protease K, before amplification or before assaying for a detectable signal. Often, a protease treatment is for no more than 15 minutes. Sometimes, the protease treatment is for no more than 1, 5, 10, 15, 20, 25, 30, or more minutes, or any value from 1 to 30 minutes. Sometimes, the protease treatment is from 1 to 30, from 5 to 25, from 10 to 20, or from 10 to 15 minutes. Sometimes, the total time for the performing the method described herein is no greater than 3 hours, 2 hours, 1 hour, 50 minutes, 40 minutes, 30 minutes, 20 minutes, or any value from 3 hours to 20 minutes. Often, a method of nucleic acid detection from a raw sample comprises protease treating the sample for no more than 15 minutes, amplifying (can also be referred to as pre-amplifying) the sample for no more than 15 minutes, subjecting the sample to a programmable nuclease-mediated detection, and assaying nuclease mediated detection. The total time for performing this method, sometimes, is no greater than 3 hours, 2 hours, 1 hour, 50 minutes, 40 minutes, 30 minutes, 20 minutes, or any value from 3 hours to 20 minutes. Often, the protease treatment is Protease K. Often the amplifying is thermal cycling amplification. Sometimes the amplifying is isothermal amplification.

Fluidic Devices

Disclosed herein are various fluidic devices for assaying for a signal indicating cleavage of at least some detector nucleic acids of a population of detector nucleic acids. The fluidic devices described herein can be used to monitor the signal indicating cleavage of at least some detector nucleic acids of a population of detector nucleic acids that occurs when a target nucleic acid in samples binding to a programmable nuclease complexed with a guide nucleic acid, thereby allowing initiating cleavage of detector nucleic acids that produce a signal upon cleavage. All samples and reagents disclosed herein are compatible for use with a fluidic device disclosed below. Any programmable nuclease, such as any Cas nuclease described herein, are compatible for use with a fluidic device disclosed below. Support mediums and housing disclosed herein are also compatible for use in conjunction with the fluidic devices disclosed below. Multiplexing detection, as described throughout the present disclosure, can be carried out within the fluidic devices disclosed herein. Compositions and methods for detection and visualization disclosed herein are also compatible for use within the below described fluidic systems.

A workflow of a method for assaying a target nucleic acid in a sample within a fluidic device can include sample preparation, nucleic acid amplification, incubation with a programmable nuclease, and/or detection (readout). For example, a step 1 is sample preparation, a step 2 is nucleic acid amplification, a step 3 is programmable nuclease incubation, and a step 4 is detection (readout). In some embodiments, amplification comprises producing a PAM target nucleic acid. Sometimes, steps 1 and 2 are optional. Steps 3 and 4 can occur concurrently, if incubation and detection of programmable nuclease activity are within the same chamber. Sample preparation and amplification can be carried out within a fluidic device described herein or, alternatively, can be carried out prior to introduction into the fluidic device. As mentioned above, sample preparation of any nucleic acid amplification are optional, and can be excluded. In further cases, programmable nuclease reaction incubation and detection (readout) can be performed sequentially (one after another) or concurrently (at the same time). In some embodiments, sample preparation and/or amplification can be performed within a first fluidic device and then the sample can be transferred to a second fluidic device to carry out Steps 3 and 4 and, optionally, Step 2.

A fluidic device for sample preparation can be referred to as a filtration device. In some embodiments, the filtration device for sample preparation resembles a syringe or, comprises, similar functional elements to a syringe. For example, a functional element of the filtration device for sample preparation includes a narrow tip for collection of liquid samples. Liquid samples can include blood, saliva, urine, or any other biological fluid. Liquid samples can also include liquid tissue homogenates. The tip, for collection of liquid samples, can be manufactured from glass, metal, plastic, or other biocompatible materials. The tip may be replaced with a glass capillary that may serve as a metering apparatus for the amount of biological sample added downstream to the fluidic device. For some samples, e.g., blood, the capillary may be the only fluidic device required for sample preparation. Another functional element of the filtration device for sample preparation may include a channel that can carry volumes from nL to mL, containing lysis buffers compatible with the programmable nuclease reaction downstream of this process. The channel may be manufactured from metal, plastic, or other biocompatible materials. The channel may be large enough to hold an entire fecal, buccal, or other biological sample collection swab. The filtration device may further contain a solution of reagents that will lyse the cells in each type of samples and release the nucleic acids so that they are accessible to the programmable nuclease. Active ingredients of the solution may be chaotropic agents, detergents, salts, and can be of high osmolality, ionic strength and pH. Chaotropic agents or chaotropes are substances that disrupt the three-dimensional structure in macromolecules such as proteins, DNA, or RNA. One example protocol comprises a 4 M guanidinium isothiocyanate, 25 mM sodium citrate.$2H_2O$, 0.5% (w/v) sodium lauryl sarcosinate, and 0.1 M β-mercaptoethanol), but numerous commercial buffers for different cellular targets may also be used. Alkaline buffers may also be used for cells with hard shells, particularly for environmental samples. Detergents such as sodium dodecyl sulphate (SDS) and cetyl trimethylammonium bromide (CTAB) may also be implemented to chemical lysis buffers. Cell lysis may also be performed by physical, mechanical, thermal or enzymatic means, in addition to chemically-induced cell lysis mentioned previously. The device may include more complex architecture depending on the type of sample, such as nanoscale barbs, nanowires, sonication capability in a separate chamber of the device, integrated laser, integrated heater, for example, a Peltier-type heater, or a thin-film planar heater, and/or microcapillary probes for electrical lysis. Any samples described herein can be used in this workflow. For example samples may include liquid samples collected from a subject being tested for a condition of interest. The sample preparation fluidic device can process different types of biological sample: finger-prick blood, urine or swabs with fecal, cheek or other collection.

A fluidic device may be used to carry out any one of, or any combination of, steps 2-4 discussed above (nucleic acid amplification, programmable nuclease reaction incubation, detection (readout)). An example fluidic device for a programmable nuclease reaction with a fluorescence or electrochemical readout that may be used in Step 2 to Step 4 can be carried out in different iterations. For example, one variation is a fluidic device that performs the programmable nuclease reaction incubation and detection (readout) steps, but not amplification. Another variation of a fluidic device comprises a one-chamber reaction with amplification. Another variation of the fluidic device comprises a two-chamber reaction with amplification. Fluorescence or electrochemical processes that may be used for detection of the reaction in a fluidic device as described above.

The chip (also referred to as fluidic device) may be manufactured from a variety of different materials. Exemplary materials that may be used include plastic polymers, such as poly-methacrylate (PMMA), cyclic olefin polymer (COP), cyclic olefin copolymer (COC), polyethylene (PE), high-density polyethylene (HDPE), polypropylene (PP); glass; and silicon. Features of the chip may be manufactured by various processes. For example, features may be (1) embossed using injection molding, (2) micro-milled or micro-engraved using computer numerical control (CNC) micromachining, or non-contact laser drilling (by means of a CO2 laser source); (3) additive manufacturing, and/or (4) photolithographic methods.

The design may include up to three (3) input ports operated by three (3) pumps, for example. The pumps may be operated by external syringe pumps using low pressure or high pressure. The pumps may be passive, and/or active (pneumatic, piezoelectric, Braille pin, electroosmotic, acoustic, gas permeation, or other).

The ports may be connected to pneumatic pressure pumps, air or gas may be pumped into the microfluidic channels to control the injection of fluids into the fluidic device. At least three reservoirs may be connected to the device, each containing buffered solutions of: (1) sample, which may be a solution containing purified nucleic acids processed in a separate fluidic device, or neat sample (blood, saliva, urine, stool, and/or sputum); (2) amplification mastermix, which varies depending on the method used, wherein the method may include any of loop-mediated isothermal amplification (LAMP), strand displacement amplification (SDA), recombinase polymerase amplification (RPA), helicase dependent amplification (HDA), multiple displacement amplification (MDA), rolling circle amplification (RCA), and nucleic acid sequence-based amplification (NASBA), transcription mediated amplification (TMA), circular helicase dependent amplification (cHDA), exponential amplification reaction (EXPAR), ligase chain reaction (LCR), simple method amplifying RNA targets (SMART), single primer isothermal amplification (SPIA), hinge-initiated primer-dependent amplification of nucleic acids (HIP), nicking enzyme amplification reaction (NEAR), or improved multiple displacement amplification (IMDA); and (3) pre-complexed programmable nuclease mix, which includes one or more programmable nuclease and guide oligonucleotides. The method of nucleic acid amplification may also be polymerase chain reaction (PCR), which includes cycling of the incubation temperature at different levels, hence is not defined as isothermal. Often, the reagents for nucleic acid amplification comprise a recombinase, a oligonucleotide primer, a single-stranded DNA binding (SSB) protein, and a polymerase. Sometimes, nucleic acid amplification of the sample improves at least one of sensitivity, specificity, or accuracy of the assay in detecting the target nucleic acid. In some cases, the nucleic acid amplification is performed in a nucleic acid amplification region on the support medium. The nucleic amplification can produce a PAM target nucleic acid as disclosed by the methods herein. Alternatively or in combination, the nucleic acid amplification is performed in a reagent chamber, and the resulting sample is applied to the support medium. Sometimes, the nucleic acid amplification is isothermal nucleic acid amplification. Complex formation of a nuclease with guides (a programmable nuclease) and reporter probes may occur off the chip. An additional port for output of the final reaction products is depicted at the end of the fluidic path, and is operated by a similar pump. The reactions product can be, thus, collected for additional processing and/or characterization, e.g., sequencing.

The flow of liquid in this fluidic device may be controlled using up to four (4) microvalves. These valves can be electro-kinetic microvalves, pneumatic microvalves, vacuum microvalves, capillary microvalves, pinch microvalves, phase-change microvalves, burst microvalves.

The flow to and from the fluidic channel from each microvalve can be controlled by valves. The volume of liquids pumped into the ports can vary from nL to mL depending in the overall size of the device.

A fluidic device in which no amplification is needed can also be used. After addition of sample and pre-complexed programmable nuclease mix, these reagents may be mixed in a serpentine channel which then leads to a chamber where the mixture may be incubated at the required temperature and time. The readout can be done simultaneously in the chamber. Thermoregulation in the chamber may be carried out using a thin-film planar heater manufactured, from e.g. Kapton, or other similar materials, and controlled by a proportional integral derivative (PID).

A fluidic device may also allow for addition of sample, amplification mix, and pre-complexed programmable nuclease mix, the reagents to then be mixed in a serpentine channel which then leads to a chamber where the mixture is incubated at the required temperature and time needed to efficient amplification, using any of the amplification methods described herein. The readout may be done simultaneously in the chamber. Thermoregulation may be achieved as previously described.

A fluidic device can allow for amplification and programmable nuclease reactions occur in separate chambers. The pre-complexed programmable nuclease mix can be pumped into the amplified mixture from a first chamber using a pump. The liquid flow is controlled by a valve, and directed into a serpentine mixer, and subsequently in another chamber for incubation the required temperature, for example at 37° C. for 90 minutes.

During the detection step (step 4, for example), the programmable nuclease complexed to a guide nucleic acid binds to its target nucleic acid from the amplified sample to initiate cleavage of a detector nucleic acid to generate a signal readout. In the absence of a target nucleic acid, the programmable nuclease complexed to a guide nucleic acid does not cleave the detector nucleic acid. Detection of the signal can be achieved by multiple methods, which can detect a signal that is calorimetric, potentiometric, amperometric, optical (e.g., fluorescent, colorimetric, etc.), or piezo-electric, as non-limiting examples.

Support Medium

A number of support mediums are consistent with the methods disclosed herein. These support mediums are, for example, consistent with fluidic devices disclosed herein for detection of a target nucleic acid sequence within the sample, wherein the fluidic device may comprise multiple pumps, valves, reservoirs, and chambers for sample preparation, amplification of a target nucleic acid sequence within the sample, mixing with a programmable nuclease, and detection of a detectable signal arising from cleavage of detector nucleic acids by the programmable nuclease within the fluidic system itself. These support mediums are compatible with the DETECTR assay methods disclosed herein. The support mediums, as described herein, are compatible with any of the programmable nucleases disclosed herein (e.g., a programmable nuclease with at least 60% sequence identity to SEQ ID NO: 11) and use of said programmable nuclease in a method of detecting a target nucleic acid. The support mediums, as described herein, are compatible with any of the compositions comprising a programmable nuclease and a buffer, which has been developed to improve the function of the programmable nuclease (e.g., a programmable nuclease and a buffer with low salt (about 110 mM or less) and a pH of 7 to 8) and use of said compositions in a method of detecting a target nucleic acid. The support mediums, as described herein, are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence. In some embodiments, amplification of the target nucleic acid sequence within the sample comprises producing a PAM target nucleic acid. These support mediums are compatible with the samples, reagents, and fluidic devices described herein for detection of an ailment, such as a disease, cancer, or genetic disorder, or genetic information, such as for phenotyping, genotyping, or determining ancestry. A support medium described herein can provide a way to present the results from the activity between the reagents and the sample. The support medium provides a medium to present the detectable signal in a detectable format. Optionally, the support medium concentrates the detectable signal to a detection spot in a detection region to increase the sensitivity, specificity, or accuracy of the assay. The support mediums can present the results of the assay and indicate the presence or absence of the disease of interest targeted by the target nucleic acid. The result on the support medium can be read by eye or using a machine. The support medium helps to stabilize the detectable signal generated by the cleaved detector molecule on the surface of the support medium. In some instances, the support medium is a lateral flow assay strip. In some instances, the support medium is a PCR plate. The PCR plate can have 96 wells or 384 wells. The PCR plate can have a subset number of wells of a 96 well plate or a 384 well plate. A subset number of wells of a 96 well PCR plate is, for example, 1, 2, 3, 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, or 95 wells. For example, a PCR subset plate can have 4 wells wherein a well is the size of a well from a 96 well PCR plate (e.g., a 4 well PCR subset plate wherein the wells are the size of a well from a 96 well PCR plate). A subset number of wells of a 384 well PCR plate is, for example, 1, 2, 3, 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 110, 120, 130, 140, 150, 160, 170, 180, 190, 200, 220, 240, 260, 280, 300, 320, 340, 360, or 380 wells. For example, a PCR subset plate can have 20 wells wherein a well is the size of a well from a 384 well PCR plate (e.g., a 20 well PCR subset plate wherein the wells are the size of a well from a 384 well PCR plate). The PCR plate or PCR subset plate can be paired with a fluorescent light reader, a visible light reader, or other imaging device. Often, the imaging device is a digital camera, such a digital camera on a mobile device. The mobile device may have a software program or a mobile application that can capture an image of the PCR plate or PCR subset plate, identify the assay being performed, detect the individual wells and the sample therein, provide image properties of the individuals wells comprising the assayed sample, analyze the image properties of the contents of the individual wells, and provide a result.

The support medium has at least one specialized zone or region to present the detectable signal. The regions comprise at least one of a sample pad region, a nucleic acid amplification region, a conjugate pad region, a detection region, and a collection pad region. In some instances, the regions are overlapping completely, overlapping partially, or in series and in contact only at the edges of the regions, where the regions are in fluid communication with its adjacent regions. In some instances, the support medium has a sample pad located upstream of the other regions; a conjugate pad region having a means for specifically labeling the detector moiety; a detection region located downstream from sample pad; and at least one matrix which defines a flow path in fluid connection with the sample pad. In some instances, the support medium has an extended base layer on top of which the various zones or regions are placed. The extended base layer may provide a mechanical support for the zones.

Described herein are sample pad that provide an area to apply the sample to the support medium. The sample may be applied to the support medium by a dropper or a pipette on top of the sample pad, by pouring or dispensing the sample on top of the sample pad region, or by dipping the sample pad into a reagent chamber holding the sample. The sample can be applied to the sample pad prior to reaction with the reagents when the reagents are placed on the support medium or be reacted with the reagents prior to application on the sample pad. The sample pad region can transfer the reacted reagents and sample into the other zones of the support medium. Transfer of the reacted reagents and sample may be by capillary action, diffusion, convection or active transport aided by a pump. In some cases, the support medium is integrated with or overlayed by microfluidic channels to facilitate the fluid transport.

The dropper or the pipette may dispense a predetermined volume. In some cases, the predetermined volume may range from about 1 µl to about 1000 µl, about 1 µl to about 500 µl, about 1 µl to about 100 µl, or about 1 µl to about 50 µl. In some cases, the predetermined volume may be at least 1 µl, 2 µl, 3 µl, 4 µl, 5 µl, 6 µl, 7 µl, 8 µl, 9 µl, 10 µl, 25 µl, 50 µl, 75 µl, 100 µl, 250 µl, 500 µl, 750 µl, or 1000 µl. The predetermined volume may be no more than 5 µl, 10 µl, 25 µl, 50 µl, 75 µl, 100 µl, 250 µl, 500 µl, 750 µl, or 1000 µl. The dropper or the pipette may be disposable or be single-use.

Optionally, a buffer or a fluid may also be applied to the sample pad to help drive the movement of the sample along the support medium. In some cases, the volume of the buffer or the fluid may range from about 1 µl to about 1000 µl, about 1 µl to about 500 µl, about 1 µl to about 100 µl, or about 1 µl to about 50 µl. In some cases, the volume of the buffer or the fluid may be at least 1 µl, 2 µl, 3 µl, 4 µl, 5 µl, 6 µl, 7 µl, 8 µl, 9 µl, 10 µl, 25 µl, 50 µl, 75 µl, 100 µl, 250 µl, 500 µl, 750 µl, or 1000 µl. The volume of the buffer or the fluid may be no more than 5 µl, 10 µl, 25 µl, 50 µl, 75 µl, 100 µl, 250 µl, 500 µl, 750 µl, or 1000 µl. In some cases, the buffer or fluid may have a ratio of the sample to the buffer or fluid of at least 1:1, 1:2, 1:3, 1:4, 1:5, 1:6, 1:7, 1:8, 1:9, or 1:10.

The sample pad can be made from various materials that transfer most of the applied reacted reagents and samples to the subsequent regions. The sample pad may comprise cellulose fiber filters, woven meshes, porous plastic membranes, glass fiber filters, aluminum oxide coated membranes, nitrocellulose, paper, polyester filter, or polymer-based matrices. The material for the sample pad region may be hydrophilic and have low non-specific binding. The material for the sample pad may range from about 50 µm to about 1000 µm, about 50 µm to about 750 µm, about 50 µm to about 500 µm, or about 100 µm to about 500 µm.

The sample pad can be treated with chemicals to improve the presentation of the reaction results on the support medium. The sample pad can be treated to enhance extraction of nucleic acid in the sample, to control the transport of the reacted reagents and sample or the conjugate to other regions of the support medium, or to enhance the binding of the cleaved detection moiety to the conjugate binding molecule on the surface of the conjugate or to the capture molecule in the detection region. The chemicals may comprise detergents, surfactants, buffers, salts, viscosity enhancers, or polypeptides. In some instances, the chemical comprises bovine serum albumin.

Described herein are conjugate pads that provide a region on the support medium comprising conjugates coated on its surface by conjugate binding molecules that can bind to the detector moiety from the cleaved detector molecule or to the control molecule. The conjugate pad can be made from various materials that facilitate binding of the conjugate binding molecule to the detection moiety from cleaved detector molecule and transfer of most of the conjugate-bound detection moiety to the subsequent regions. The conjugate pad may comprise the same material as the sample pad or other zones or a different material than the sample pad. The conjugate pad may comprise glass fiber filters, porous plastic membranes, aluminum oxide coated membranes, paper, cellulose fiber filters, woven meshes, polyester filter, or polymer-based matrices. The material for the conjugate pad region may be hydrophilic, have low non-specific binding, or have consistent fluid flow properties across the conjugate pad. In some cases, the material for the conjugate pad may range from about 50 µm to about 1000 µm, about 50 µm to about 750 µm, about 50 µm to about 500 µm, or about 100 µm to about 500 µm.

Further described herein are conjugates that are placed on the conjugate pad and immobilized to the conjugate pad until the sample is applied to the support medium. The conjugates may comprise a nanoparticle, a gold nanoparticle, a latex nanoparticle, a quantum dot, a chemiluminescent nanoparticle, a carbon nanoparticle, a selenium nanoparticle, a fluorescent nanoparticle, a liposome, or a dendrimer. The surface of the conjugate may be coated by a conjugate binding molecule that binds to the detection moiety from the cleaved detector molecule.

The conjugate binding molecules described herein coat the surface of the conjugates and can bind to detection moiety. The conjugate binding molecule binds selectively to the detection moiety cleaved from the detector nucleic acid. Some suitable conjugate binding molecules comprise an antibody, a polypeptide, or a single stranded nucleic acid. In some cases, the conjugate binding molecule binds a dye and a fluorophore. Some such conjugate binding molecules that bind to a dye or a fluorophore can quench their signal. In some cases, the conjugate binding molecule is a monoclonal antibody. In some cases, an antibody, also referred to as an immunoglobulin, includes any isotype, variable regions, constant regions, Fc region, Fab fragments, F(ab')2 fragments, and Fab' fragments. Alternatively, the conjugate binding molecule is a non-antibody compound that specifically binds the detection moiety. Sometimes, the conjugate binding molecule is a polypeptide that can bind to the detection moiety. Sometimes, the conjugate binding molecule is avidin or a polypeptide that binds biotin. Sometimes, the conjugate binding molecule is a detector moiety binding nucleic acid.

The diameter of the conjugate may be selected to provide a desired surface to volume ratio. In some instances, a high surface area to volume ratio may allow for more conjugate binding molecules that are available to bind to the detection moiety per total volume of the conjugates. In some cases, the diameter of the conjugate may range from about 1 nm to about 1000 nm, about 1 nm to about 500 nm, about 1 nm to about 100 nm, or about 1 nm to about 50 nm. In some cases, the diameter of the conjugate may be at least 1 nm, 2 nm, 3 nm, 4 nm, 5 nm, 6 nm, 7 nm, 8 nm, 9 nm, 10 nm, 15 nm, 20 nm, 25 nm, 30 nm, 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 200 nm, 300 nm, 400 nm, 500 nm, 600 nm, 700 nm, 800 nm, 900 nm, or 1000 nm. In some cases, the diameter of the conjugate may be no more than 1 nm, 2 nm, 3 nm, 4 nm, 5 nm, 6 nm, 7 nm, 8 nm, 9 nm, 10 nm, 15 nm, 20 nm, 25 nm, 30 nm, 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 200 nm, 300 nm, 400 nm, 500 nm, 600 nm, 700 nm, 800 nm, 900 nm, or 1000 nm.

The ratio of conjugate binding molecules to the conjugates can be tailored to achieve desired binding properties between the conjugate binding molecules and the detection moiety. In some instances, the molar ratio of conjugate binding molecules to the conjugates is at least 1:1, 1:5, 1:10, 1:20, 1:30, 1:40, 1:50, 1:60, 1:70, 1:80, 1:90, 1:100, 1:110, 1:120, 1:130, 1:140, 1:150, 1:160, 1:170, 1:180, 1:190, 1:200, 1:250, 1:300, 1:350, 1:400, 1:450, or 1:500. In some instances, the mass ratio of conjugate binding molecules to the conjugates is at least 1:1, 1:5, 1:10, 1:20, 1:30, 1:40, 1:50, 1:60, 1:70, 1:80, 1:90, 1:100, 1:110, 1:120, 1:130, 1:140, 1:150, 1:160, 1:170, 1:180, 1:190, 1:200, 1:250, 1:300, 1:350, 1:400, 1:450, or 1:500. In some instances, the number of conjugate binding molecules per conjugate is at least 1, 10, 50, 100, 500, 1000, 5000, or 10000.

The conjugate binding molecules can be bound to the conjugates by various approached. Sometimes, the conjugate binding molecule can be bound to the conjugate by passive binding. Some such passive binding comprise adsorption, absorption, hydrophobic interaction, electrostatic interaction, ionic binding, or surface interactions. In some cases, the conjugate binding molecule can be bound to the conjugate covalently. Sometimes, the covalent bonding of the conjugate binding molecule to the conjugate is facilitated by EDC/NHS chemistry or thiol chemistry.

Described herein are detection region on the support medium that provide a region for presenting the assay results. The detection region can be made from various materials that facilitate binding of the conjugate-bound detection moiety from cleaved detector molecule to the capture molecule specific for the detection moiety. The detection pad may comprise the same material as other zones or a different material than the other zones. The detection region may comprise nitrocellulose, paper, cellulose, cellulose fiber filters, glass fiber filters, porous plastic membranes, aluminum oxide coated membranes, woven meshes, polyester filter, or polymer-based matrices. Often the detection region may comprise nitrocellulose. The material for the region pad region may be hydrophilic, have low non-specific binding, or have consistent fluid flow properties across the region pad. The material for the conjugate pad may range from about 10 µm to about 1000 µm, about 10 µm to about 750 µm, about 10 µm to about 500 µm, or about 10 µm to about 300 µm.

The detection region comprises at least one capture area with a high density of a capture molecule that can bind to the detection moiety from cleaved detection molecule and at least one area with a high density of a positive control capture molecule. The capture area with a high density of capture molecule or a positive control capture molecule may be a line, a circle, an oval, a rectangle, a triangle, a plus sign, or any other shapes. In some instances, the detection region comprise more than one capture area with high densities of more than one capture molecules, where each capture area comprises one type of capture molecule that specifically binds to one type of detection moiety from cleaved detection molecule and are different from the capture molecules in the other capture areas. The capture areas with different capture molecules may be overlapping completely, overlapping partially, or spatially separate from each other. In some instances, the capture areas may overlap and produce a combined detectable signal distinct from the detectable signals generated by the individual capture areas. Usually, the positive control spot is spatially distinct from any of the detection spot.

The capture molecule described herein bind to detection moiety and immobilized in the detection spot in the detect region. Some suitable capture molecules comprise an antibody, a polypeptide, or a single stranded nucleic acid. In some cases, the capture molecule binds a dye and a fluorophore. Some such capture molecules that bind to a dye or a fluorophore can quench their signal. Sometimes, the capture molecule is an antibody that that binds to a dye or a fluorophore can quench their signal. In some cases, the capture molecule is a monoclonal antibody. In some cases, an antibody, also referred to as an immunoglobulin, includes any isotype, variable regions, constant regions, Fc region, Fab fragments, F(ab')2 fragments, and Fab' fragments. Alternatively, the capture molecule is a non-antibody compound that specifically binds the detection moiety. Sometimes, the capture molecule is a polypeptide that can bind to the detection moiety. In some instances, the detection moiety from cleaved detection molecule has a conjugate bound to the detection moiety, and the conjugate-detection moiety complex may bind to the capture molecule specific to the detection moiety on the detection region. Sometimes, the capture molecule is a polypeptide that can bind to the detection moiety. Sometimes, the capture molecule is avidin or a polypeptide that binds biotin. Sometimes, the capture molecule is a detector moiety binding nucleic acid.

The detection region described herein comprises at least one area with a high density of a positive control capture molecule. The positive control spot in the detection region provides a validation of the assay and a confirmation of completion of the assay. If the positive control spot is not detectable by the visualization methods described herein, the assay is not valid and should be performed again with a new system or kit. The positive control capture molecule binds at least one of the conjugate, the conjugate binding molecule, or detection moiety and is immobilized in the positive control spot in the detect region. Some suitable positive control capture molecules comprise an antibody, a polypeptide, or a single stranded nucleic acid. In some cases, the positive control capture molecule binds to the conjugate binding molecule. Some such positive control capture molecules that bind to a dye or a fluorophore can quench their signal. Sometimes, the positive control capture molecule is an antibody that that binds to a dye or a fluorophore can quench their signal. In some cases, the positive control capture molecule is a monoclonal antibody. In some cases, an antibody includes any isotype, variable regions, constant regions, Fc region, Fab fragments, F(ab')2 fragments, and Fab' fragments. Alternatively, the positive control capture molecule is a non-antibody compound that specifically binds the detection moiety. Sometimes, the positive control capture molecule is a polypeptide that can bind to at least one of the conjugate, the conjugate binding molecule, or detection moiety. In some instances, the conjugate unbound to the detection moiety binds to the positive control capture molecule specific to at least one of the conjugate or the conjugate binding molecule.

The kit or system described herein may also comprise a positive control sample to determine that the activity of at least one of programmable nuclease, a guide nucleic acid, or a single stranded detector nucleic acid. Often, the positive control sample comprises a target nucleic acid that binds to the guide nucleic acid. The positive control sample is contacted with the reagents in the same manner as the test sample and visualized using the support medium. The visualization of the positive control spot and the detection spot for the positive control sample provides a validation of the reagents and the assay.

The kit or system for detection of a target nucleic acid described herein further comprises reagents for nucleic acid amplification of target nucleic acids in the sample. Isothermal nucleic acid amplification allows the use of the kit or system in remote regions or low resource settings without specialized equipment for amplification. Often, the reagents for nucleic acid amplification comprise a recombinase, an oligonucleotide primer, a single-stranded DNA binding (SSB) protein, and a polymerase. Sometimes, nucleic acid amplification of the sample improves at least one of sensitivity, specificity, or accuracy of the assay in detecting the target nucleic acid. In some cases, the nucleic acid amplification is performed in a nucleic acid amplification region on the support medium. Alternatively, or in combination, the nucleic acid amplification is performed in a reagent chamber, and the resulting sample is applied to the support medium. Sometimes, the nucleic acid amplification is isothermal nucleic acid amplification. In some cases, the nucleic acid amplification is transcription mediated amplification (TMA). Nucleic acid amplification is helicase dependent amplification (HDA) or circular helicase dependent amplification (cHDA) in other cases. In additional cases, nucleic acid amplification is strand displacement amplification (SDA). In some cases, nucleic acid amplification is by recombinase polymerase amplification (RPA). In some cases, nucleic acid amplification is by at least one of loop mediated amplification (LAMP) or the exponential amplification reaction (EXPAR). Nucleic acid amplification is, in some cases, by rolling circle amplification (RCA), ligase chain reaction (LCR), simple method amplifying RNA targets (SMART), single primer isothermal amplification (SPIA), multiple displacement amplification (MDA), nucleic acid sequence based amplification (NASBA), hinge-initiated primer-dependent amplification of nucleic acids (HIP), nicking enzyme amplification reaction (NEAR), or improved multiple displacement amplification (IMDA). Often, the nucleic acid amplification is performed for no greater than 1, 2, 3, 4, 5, 6, 7, 8, 9, 10, 11, 12, 13, 14, 15, 16, 17, 18, 19, 20, 25, 30, 40, 50, or 60 minutes. Sometimes, the nucleic acid amplification reaction is performed at a temperature of around 20-45° C. In some cases, the nucleic acid amplification reaction is performed at a temperature no greater than 20° C., 25° C., 30° C., 35° C., 37° C., 40° C., 45° C. In some cases, the nucleic acid amplification reaction is performed at a temperature of at least 20° C., 25° C., 30° C., 35° C., 37° C., 40° C., or 45° C. Sometimes the nucleic acid amplification uses dTTP, dATP, dCTP, and dGTP. Often, the nucleic acid amplification uses dUTP, dATP, dCTP, and dGTP.

Described herein are collection pad region that provide a region to collect the sample that flows down the support medium. Often the collection pads are placed downstream of the detection region and comprise an absorbent material. The collection pad can increase the total volume of sample that enters the support medium by collecting and removing the sample from other regions of the support medium. This increased volume can be used to wash unbound conjugates away from the detection region to lower the background and enhance assay sensitivity. When the design of the support medium does not include a collection pad, the volume of sample analyzed in the support medium may be determined by the bed volume of the support medium. The collection pad may provide a reservoir for sample volume and may help to provide capillary force for the flow of the sample down the support medium.

The collection pad may be prepared from various materials that are highly absorbent and able to retain fluids. Often the collection pads comprise cellulose filters. In some instances, the collection pads comprise cellulose, cotton, woven meshes, polymer-based matrices. The dimension of the collection pad, usually the length of the collection pad, may be adjusted to change the overall volume absorbed by the support medium.

The support medium described herein may have a barrier around the edge of the support medium. Often the barrier is a hydrophobic barrier that facilitates the maintenance of the sample within the support medium or flow of the sample within the support medium. Usually, the transport rate of the sample in the hydrophobic barrier is much lower than through the regions of the support medium. In some cases, the hydrophobic barrier is prepared by contacting a hydrophobic material around the edge of the support medium. Sometimes, the hydrophobic barrier comprises at least one of wax, polydimethylsiloxane, rubber, or silicone.

Any of the regions on the support medium can be treated with chemicals to improve the visualization of the detection spot and positive control spot on the support medium. The regions can be treated to enhance extraction of nucleic acid in the sample, to control the transport of the reacted reagents and sample or the conjugate to other regions of the support medium, or to enhance the binding of the cleaved detection moiety to the conjugate binding molecule on the surface of the conjugate or to the capture molecule in the detection region. The chemicals may comprise detergents, surfactants, buffers, salts, viscosity enhancers, or polypeptides. In some instances, the chemical comprises bovine serum albumin. In some cases, the chemicals or physical agents enhance flow of the sample with a more even flow across the width of the region. In some cases, the chemicals or physical agents provide a more even mixing of the sample across the width of the region. In some cases, the chemicals or physical agents control flow rate to be faster or slower in order to improve performance of the assay. Sometimes, the performance of the assay is measured by at least one of shorter assay time, longer times during cleavage activity, longer or shorter binding time with the conjugate, sensitivity, specificity, or accuracy.

Housing

A support medium as described herein can be housed in a number of ways that are consistent with the methods disclosed herein. The housing for the support medium are, for example, consistent with fluidic devices disclosed herein for detection of a target nucleic acid sequence within the sample, wherein the fluidic device may comprise multiple pumps, valves, reservoirs, and chambers for sample preparation, amplification of a target nucleic acid sequence within the sample, mixing with a programmable nuclease, and detection of a detectable signal arising from cleavage of detector nucleic acids by the programmable nuclease within the fluidic system itself. The housing, as described herein, are compatible with the DETECTR assay methods disclosed herein. The housing, as described herein, are compatible with any of the programmable nucleases disclosed herein (e.g., a programmable nuclease with at least 60% sequence identity to SEQ ID NO: 11) and use of said programmable nuclease in a method of detecting a target nucleic acid. The housing, as described herein, are compatible with any of the compositions comprising a programmable nuclease and a buffer, which has been developed to improve the function of the programmable nuclease (e.g., a programmable nuclease and a buffer with low salt (about 110 mM or less) and a pH of 7 to 8) and use of said compositions in a method of detecting a target nucleic acid. The housing, as described herein, are compatible with any of the methods disclosed herein including methods of assaying for at least one base difference (e.g., assaying for a SNP or a base mutation) in a target nucleic acid sequence, methods of assaying for a target nucleic acid that lacks a PAM by amplifying the target nucleic acid sequence to introduce a PAM, and compositions used in introducing a PAM via amplification into the target nucleic acid sequence. For example, the fluidic device may comprise support mediums to channel the flow of fluid from one chamber to another and wherein the entire fluidic device is encased within the housing described herein. Typically, the support medium described herein is encased in a housing to protect the support medium from contamination and from disassembly. The housing can be made of more than one part and assembled to encase the support medium. In some instances, a single housing can encase more than one support medium. The housing can be made from cardboard, plastics, polymers, or materials that provide mechanical protection for the support medium. Often, the material for the housing is inert or does not react with the support medium or the reagents placed on the support medium. The housing may have an upper part which when in place exposes the sample pad to receive the sample and has an opening or window above the detection region to allow the results of the lateral flow assay to be read. The housing may have guide pins on its inner surface that are placed around and on the support medium to help secure the compartments and the support medium in place within the housing. In some cases, the housing encases the entire support medium. Alternatively, the sample pad of the support medium is not encased and is left exposed to facilitate the receiving of the sample while the rest of the support medium is encased in the housing.

The housing and the support medium encased within the housing may be sized to be small, portable, and hand held.

The small size of the housing and the support medium would facilitate the transport and use of the assay in remote regions or low resource settings. In some cases, the housing has a length of no more than 30 cm, 25 cm, 20 cm, 15 cm, 10 cm, or 5 cm. In some cases, the housing has a length of at least 1 cm, 5 cm, 10 cm, 15 cm, 20 cm, 25 cm, or 30 cm. In some cases, the housing has a width of no more than 30 cm, 25 cm, 20 cm, 15 cm, 10 cm, 5 cm, 4 cm, 3 cm, 2 cm, or 1 cm. In some cases, the housing has a width of at least 1 cm, 2 cm, 3 cm, 4 cm, 5 cm, 10 cm, 15 cm, 20 cm, 25 cm, or 30 cm. In some cases, the housing has a height of no more than 10 cm, 9 cm, 8 cm, 7 cm, 6 cm, 5 cm, 4 cm, 3 cm, 2 cm, or 1 cm. In some cases, the housing has a height of at least 1 cm, 2 cm, 3 cm, 4 cm, 5 cm, 6 cm, 7 cm, 8 cm, 9 cm, or 10 cm. Typically, the housing is rectangular in shape.

In some instances, the housing provides additional information on the outer surface of the upper cover to facilitate the identification of the test type, visualization of the detection region, and analysis of the results. The upper outer housing may have identification label including but not limited to barcodes, QR codes, identification label, or other visually identifiable labels. In some instances, the identification label is imaged by a camera on a mobile device, and the image is analyzed to identify the disease, cancer, or genetic disorder that is being tested for. The correct identification of the test is important to accurately visualize and analyze the results. In some instances, the upper outer housing has fiduciary markers to orient the detection region to distinguish the positive control spot from the detection spots. In some instances, the upper outer housing has a color reference guide. When the detection region is imaged with the color reference guide, the detection spots, located using the fiduciary marker, can be compared with the positive control spot and the color reference guide to determine various image properties of the detection spot such as color, color intensity, and size of the spot. In some instances, the color reference guide has red, green, blue, black, and white colors. In some cases, the image of the detection spot can be normalized to at least one of the reference colors of the color reference guide, compared to at least two of the reference colors of the color reference guide, and generate a value for the detection spot. Sometimes, the comparison to at least two of the reference colors is comparison to a standard reference scale. In some instance, the image of the detection spot in some instance undergoes transformation or filtering prior to analysis. Analysis of the image properties of the detection spot can provide information regarding presence or absence of the target nucleic acid targeted by the assay and the disease, cancer, or genetic disorder associated with the target nucleic acid. In some instances, the analysis provides a qualitative result of presence or absence of the target nucleic acid in the sample. In some instances, the analysis provides a semi-quantitative or quantitative result of the level of the target nucleic acid present in the sample. Quantification may be performed by having a set of standards in spots/wells and comparing the test sample to the range of standards. A more semi-quantitative approach may be performed by calculating the color intensity of 2 spots/well compared to each other and measuring if one spot/well is more intense than the other.

Manufacturing

The support medium may be assembled with a variety of materials and reagents. Reagents may be dispensed or coated on to the surface of the material for the support medium. The material for the support medium may be laminated to a backing card, and the backing card may be singulated or cut into individual test strips. The device may be manufactured by completely manual, batch-style processing; or a completely automated, in-line continuous process; or a hybrid of the two processing approaches. The batch process may start with sheets or rolls of each material for the support medium. Individual zones of the support medium may be processed independently for dispensing and drying, and the final support medium may be assembled with the independently prepared zones and cut. The batch processing scheme may have a lower cost of equipment, and a higher labor cost than more automated in-line processing, which may have higher equipment costs. In some instances, batch processing may be preferred for low volume production due to the reduced capital investment. In some instances, automated in-line processing may be preferred for high volume production due to reduced production time. Both approaches may be scalable to production level.

In some instances, the support mediums are prepared using various instruments, including an XYZ-direction motion system with dispensers, impregnation tanks, drying ovens, a manual or semi-automated laminator, and cutting methods for reducing roll or sheet stock to appropriate lengths and widths for lamination. For dispensing the conjugate binding molecules for the conjugate zone and capture molecules for the detection zones, an XYZ-direction motion system with dispensers may be used. In some embodiments, the dispenser may dispense by a contact method or a non-contact method.

In automated or semi-automated preparation of the support medium, the support medium may be prepared from rolls of membranes for each region that are ordered into the final assembled order and unfurled from the rolls. For example, the membranes can be ordered from sample pad region to collection pad region from left to right with one membrane corresponding to a region on the support medium, all onto an adhesive cardstock. The dispenser places the reagents, conjugates, detection molecules, and other treatments for the membrane onto the membrane. The dispensed fluids are dried onto the membranes by heat, in a low humidity chamber, or by freeze drying to stabilize the dispensed molecules. The membranes are cut into strips and placed into the housing and packaged.

Kits

Disclosed herein are kits for use to detect a target nucleic acid as disclosed herein using the methods as discuss above. In some embodiments, the kit comprises the programmable nuclease system, reagents, and the support medium. The reagents and programmable nuclease system can be provided in a reagent chamber or on the support medium. Alternatively, the reagent and programmable nuclease system can be placed into the reagent chamber or the support medium by the individual using the kit. Optionally, the kit further comprises a buffer and a dropper. The reagent chamber can be a test well or container. The opening of the reagent chamber can be large enough to accommodate the support medium. The buffer can be provided in a dropper bottle for ease of dispensing. The dropper can be disposable and transfer a fixed volume. The dropper can be used to place a sample into the reagent chamber or on the support medium.

The kit or system for detection of a target nucleic acid described herein further comprises reagents for nucleic acid amplification of target nucleic acids in the sample. Isothermal nucleic acid amplification allows the use of the kit or system in remote regions or low resource settings without specialized equipment for amplification. Often, the reagents for nucleic acid amplification comprise a recombinase, a oligonucleotide primer, a single-stranded DNA binding (SSB) protein, and a polymerase. Sometimes, nucleic acid amplification of the sample improves at least one of sensitivity, specificity, or accuracy of the assay in detecting the target nucleic acid. In some cases, the nucleic acid amplification is performed in a nucleic acid amplification region on the support medium. Alternatively, or in combination, the nucleic acid amplification is performed in a reagent chamber, and the resulting sample is applied to the support medium. Sometimes, the nucleic acid amplification is isothermal nucleic acid amplification. In some cases, the nucleic acid amplification is transcription mediated amplification (TMA). Nucleic acid amplification is helicase dependent amplification (HDA) or circular helicase dependent amplification (cHDA) in other cases. In additional cases, nucleic acid amplification is strand displacement amplification (SDA). In some cases, nucleic acid amplification is by recombinase polymerase amplification (RPA). In some cases, nucleic acid amplification is by at least one of loop mediated amplification (LAMP) or the exponential amplification reaction (EXPAR). Nucleic acid amplification is, in some cases, by rolling circle amplification (RCA), ligase chain reaction (LCR), simple method amplifying RNA targets (SMART), single primer isothermal amplification (SPIA), multiple displacement amplification (MDA), nucleic acid sequence based amplification (NASBA), hinge-initiated primer-dependent amplification of nucleic acids (HIP), nicking enzyme amplification reaction (NEAR), or improved multiple displacement amplification (IMDA). Often, the nucleic acid amplification is performed for no greater than 1, 2, 3, 4, 5, 6, 7, 8, 9, 10, 11, 12, 13, 14, 15, 16, 17, 18, 19, 20, 25, 30, 40, 50, or 60 minutes, or any value from 1 to 60 minutes. Sometimes, the nucleic acid amplification is performed for from 1 to 60, from 5 to 55, from 10 to 50, from 15 to 45, from 20 to 40, or from 25 to 35 minutes. Sometimes, the nucleic acid amplification reaction is performed at a temperature of around 20-45° C. In some cases, the nucleic acid amplification reaction is performed at a temperature no greater than 20° C., 25° C., 30° C., 35° C., 37° C., 40° C., 45° C., or any value from 20° C. to 45° C. In some cases, the nucleic acid amplification reaction is performed at a temperature of at least 20° C., 25° C., 30° C., 35° C., 37° C., 40° C., or 45° C., or any value from 20° C. to 45° C. In some cases, the nucleic acid amplification reaction is performed at a temperature of from 20° C. to 45° C., from 25° C. to 40° C., from 30° C. to 40° C., or from 35° C. to 40° C.

In some embodiments, a kit for detecting a target nucleic acid comprising a support medium; a guide nucleic acid targeting a target sequence; a programmable nuclease capable of being activated when complexed with the guide nucleic acid and the target sequence; and a detector nucleic acid comprising a detection moiety, wherein the detector nucleic acid is capable of being cleaved by the activated nuclease, thereby generating a first detectable signal. Often, the kit further comprises primers for amplifying a target nucleic acid of interest to produce a PAM target nucleic acid.

In some embodiments, a kit for detecting a target nucleic acid comprising a PCR plate; a guide nucleic acid targeting a target sequence; a programmable nuclease capable of being activated when complexed with the guide nucleic acid and the target sequence; and a single stranded detector nucleic acid comprising a detection moiety, wherein the detector nucleic acid is capable of being cleaved by the activated nuclease, thereby generating a first detectable signal. The wells of the PCR plate can be pre-aliquoted with the guide nucleic acid targeting a target sequence, a programmable nuclease capable of being activated when complexed with the guide nucleic acid and the target sequence, and at least one population of a single stranded detector nucleic acid comprising a detection moiety. A user can thus add the biological sample of interest to a well of the pre-aliquoted PCR plate and measure for the detectable signal with a fluorescent light reader or a visible light reader.

In some instances, such kits may include a package, carrier, or container that is compartmentalized to receive one or more containers such as vials, tubes, and the like, each of the container(s) comprising one of the separate elements to be used in a method described herein. Suitable containers include, for example, test wells, bottles, vials, and test tubes. In one embodiment, the containers are formed from a variety of materials such as glass, plastic, or polymers.

The kit or systems described herein contain packaging materials. Examples of packaging materials include, but are not limited to, pouches, blister packs, bottles, tubes, bags, containers, bottles, and any packaging material suitable for intended mode of use.

A kit typically includes labels listing contents and/or instructions for use, and package inserts with instructions for use. A set of instructions will also typically be included. In one embodiment, a label is on or associated with the container. In some instances, a label is on a container when letters, numbers or other characters forming the label are attached, molded or etched into the container itself; a label is associated with a container when it is present within a receptacle or carrier that also holds the container, e.g., as a package insert. In one embodiment, a label is used to indicate that the contents are to be used for a specific therapeutic application. The label also indicates directions for use of the contents, such as in the methods described herein.

After packaging the formed product and wrapping or boxing to maintain a sterile barrier, the product may be terminally sterilized by heat sterilization, gas sterilization, gamma irradiation, or by electron beam sterilization. Alternatively, the product may be prepared and packaged by aseptic processing.

Unless otherwise defined, all technical terms used herein have the same meaning as commonly understood by one of ordinary skill in the art to which this invention belongs. As used in this specification and the appended claims, the singular forms "a," "an," and "the" include plural references unless the context clearly dictates otherwise. Any reference to "or" herein is intended to encompass "and/or" unless otherwise stated.

As used herein, the term "comprising" and its grammatical equivalents specifies the presence of stated features, integers, steps, operations, elements, and/or components, but do not preclude the presence or addition of one or more other features, integers, steps, operations, elements, components, and/or groups thereof. As used herein, the term "and/or" includes any and all combinations of one or more of the associated listed items.

Unless specifically stated or obvious from context, as used herein, the term "about" in reference to a number or range of numbers is understood to mean the stated number and numbers+/−10% thereof, or 10% below the lower listed limit and 10% above the higher listed limit for the values listed for a range.

As used herein the terms "individual," "subject," and "patient" are used interchangeably and include any member of the animal kingdom, including humans.

As used herein the term "antibody" refers to, but not limited to, a monoclonal antibody, a synthetic antibody, a polyclonal antibody, a multispecific antibody (including a bi-specific antibody), a human antibody, a humanized antibody, a chimeric antibody, a single-chain Fvs (scFv) (including bi-specific scFvs), a single chain antibody, a Fab fragment, a F(ab') fragment, a disulfide-linked Fvs (sdFv), or an epitope-binding fragment thereof. In some cases, the antibody is an immunoglobulin molecule or an immunologically active portion of an immunoglobulin molecule. In some instances, an antibody is animal in origin including birds and mammals. Alternately, an antibody is human or a humanized monoclonal antibody.

Figure 1:
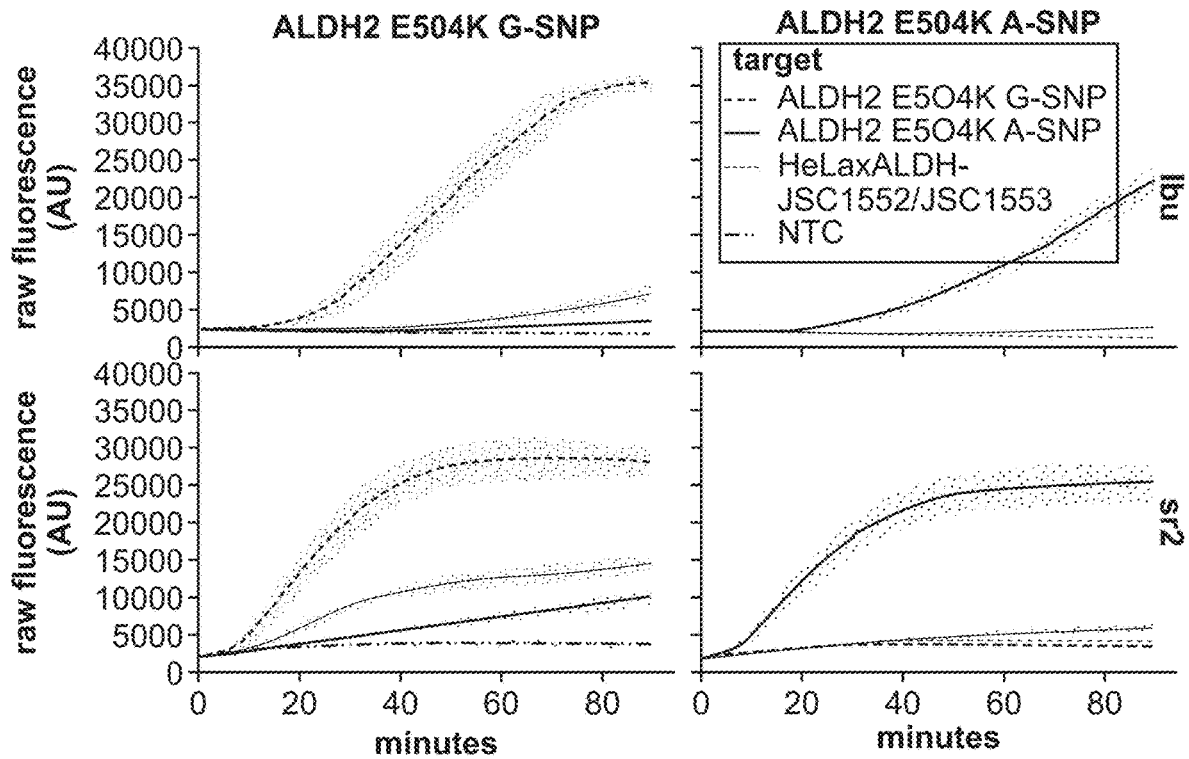
FIG. 1 shows an improved SNP detection enzyme and method. At left is shown ALDH2 E540K G-SNP, while at right one sees ALDH E540K A-SNP. The ALDH2 G-SNP was detected with a G-SNP gRNA (SEQ ID NO: 425, UAAUUUCUACUAAGUGUAGAUACUUCAGU-GUAUGCCUGCAG), and the ALDH2 A-SNP was detected with an A-SNP gRNA (SEQ ID NO: 426, UAAUUUCUA-CUAAGUGUAGAUACUUUAGUGUAUGCCUGCAG). LbCas12a (SEQ ID NO: 1) is shown at top, while a representative improved enzyme, a Cas12 variant corresponding to (SEQ ID NO: 11), is shown at bottom.

At FIG. 1, one sees an improved SNP detection enzyme and method. At left is shown ALDH2 E540K G-SNP, while at right one sees E540K A-SNP. The ALDH2 G-SNP was detected with a G-SNP gRNA (SEQ ID NO: 425), and the ALDH2 A-SNP was detected with an A-SNP gRNA (SEQ ID NO: 426). LbCas12a (SEQ ID NO: 1) is shown at top, while a representative improved enzyme, a Cas12 variant corresponding to (SEQ ID NO: 11), is shown at bottom. One sees that the improved enzyme exhibits at least a 50% improvement in reaching reporter saturation signal, and exhibits no more than 33% off target reporter signal. At right, one sees that the improvement in reaching reporter saturation signal is at least 2×, and the off target reporter signal is no greater than 10% of the target signal.

Various compositions and implementations of the methods herein achieve an improvement in reaching reporter signal saturation of at least 50%, 60%, 70%, 80%, 90%, 2×, 2.5×, 3×, 3.5×, 4×, or more than 4×, or any improvement spanned by or greater than the range of improvements listed herein. Similarly, off target signal strength is observed to be no greater than 33%, 30%, 25%, 20%, 15%, 10%, 5%, 4%, 3%, 2%, 1%, or less than 1%, or any value spanned by or less than the range of improvements listed herein.

Figure 2:
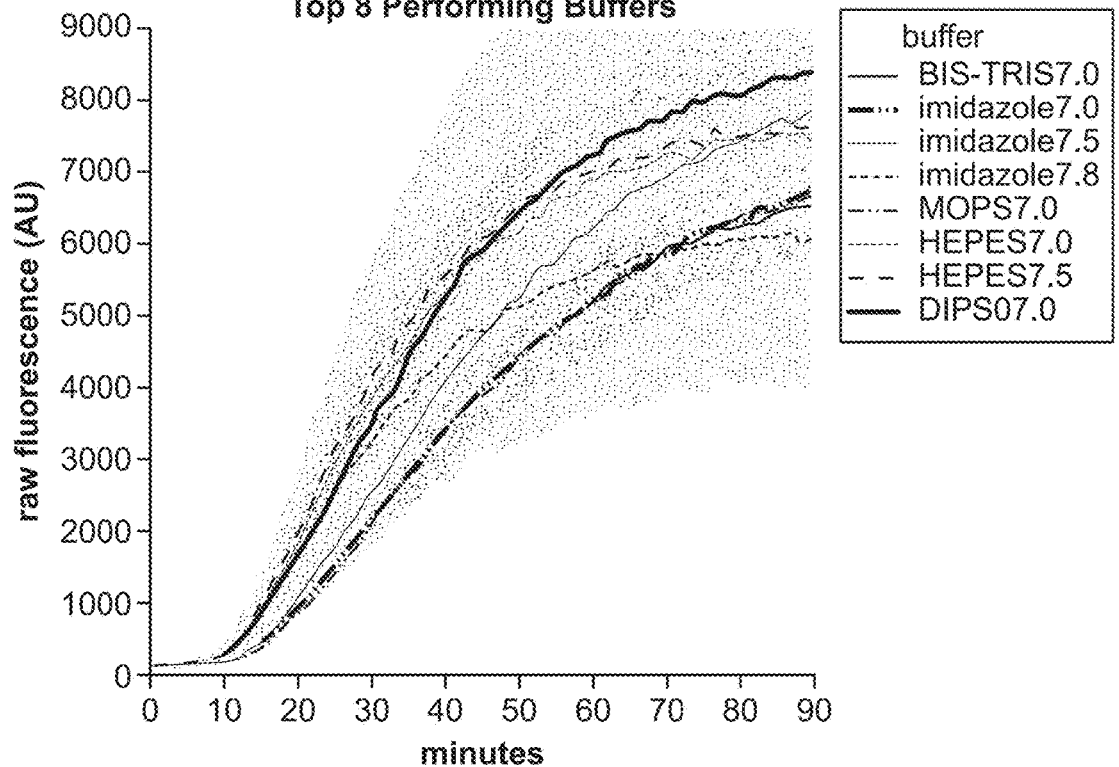
FIG. 2 shows the first of a series of experiments to assess buffer contents for detection using a Cas12 variant (SEQ ID NO: 11).

At FIG. 2, one sees the first of a series of experiments to assess buffer contents for detection using a Cas12 variant (SEQ ID NO: 11). It is observed that BIS-TRIS at pH 7.0, Imidazole at pH of 7.0, 7.5 or 7.8, MOPS at 7.0, HEPES at pH 7.0 or 7.5, and DIPSO at pH 7.0 exhibit top performance.

Accordingly, disclosed herein are buffers comprising at least one of the components listed above, at a pH such as a neutral pH, for example a pH ranging from 6.5, 6.6, 6.7, 6.8, 6.9, 7.0, 7.1, 7.2, 7.3, 7.4, 7.5, 7.6, 7.7, 7.8, 7.9, 8.0, 8.1. 8.2, 8.3, 8.4, or 8.5, or any number falling within or adjacent to the range defined thereby.

Figure 3:
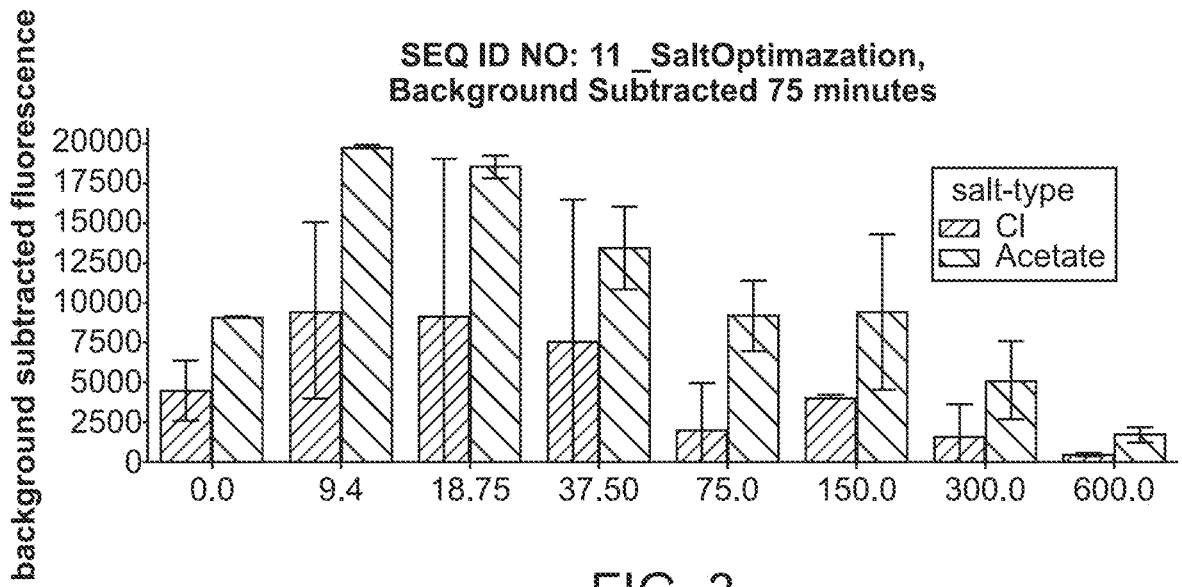
FIG. 3 shows improvements conveyed by inclusion of acetate at concentrations of about 0, 10, 20, 37, 75, 150, 300 and 600 mM, from left to right on detection using a Cas12 variant (SEQ ID NO: 11).

At FIG. 3, one sees improvements conveyed by inclusion of acetate at concentrations of about 0, 10, 20, 37, 75, 150, 300 and 600 mM, from left to right on detection using a Cas12 variant (SEQ ID NO: 11). The left bar at each concentration is Cl and right bar is acetate.

Accordingly, one sees benefits conveyed by modulation of salt concentration, for example by addition of acetate, as well as limiting salt concentration to no greater than 10, 20, 37, 75, 150, 300 and 600 mM. Particular improvements are seen at less than 75 nM, at no greater than 40 nM, and at about 10-20 nM. Disclosed herein are compositions having a reduced salt concentration, such as a salt concentration in nM of no greater than 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46,47, 48, 49, 50, 51, 52, 53, 54, 55, 56, 57, 58, 59, 60, 61, 62, 63, 64, 65, 66, 67, 68,669, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 18, 190, 200, 220, 230, 240, 250, 260, 270, 280, 290, or 300.

Figure 4:
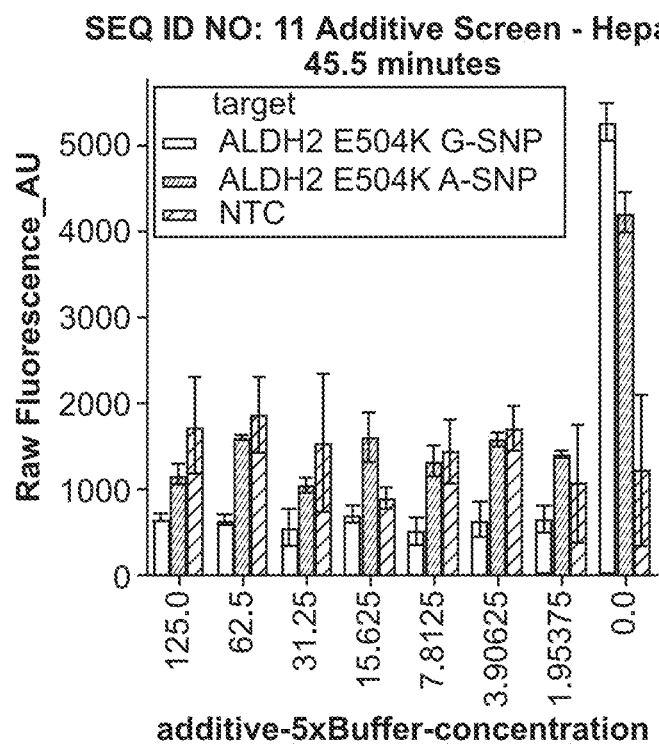
FIG. 4 shows an improvement in SNP specificity upon inclusion of heparin in a reaction buffer when detected with a Cas12 variant (SEQ ID NO: 11).

At FIG. 4, one sees an improvement in SNP specificity upon inclusion of heparin in a reaction buffer when detected with a Cas12 variant (SEQ ID NO: 11). Inclusion of heparin increases both SNP-specific detection and general enzyme performance.

Figure 5:
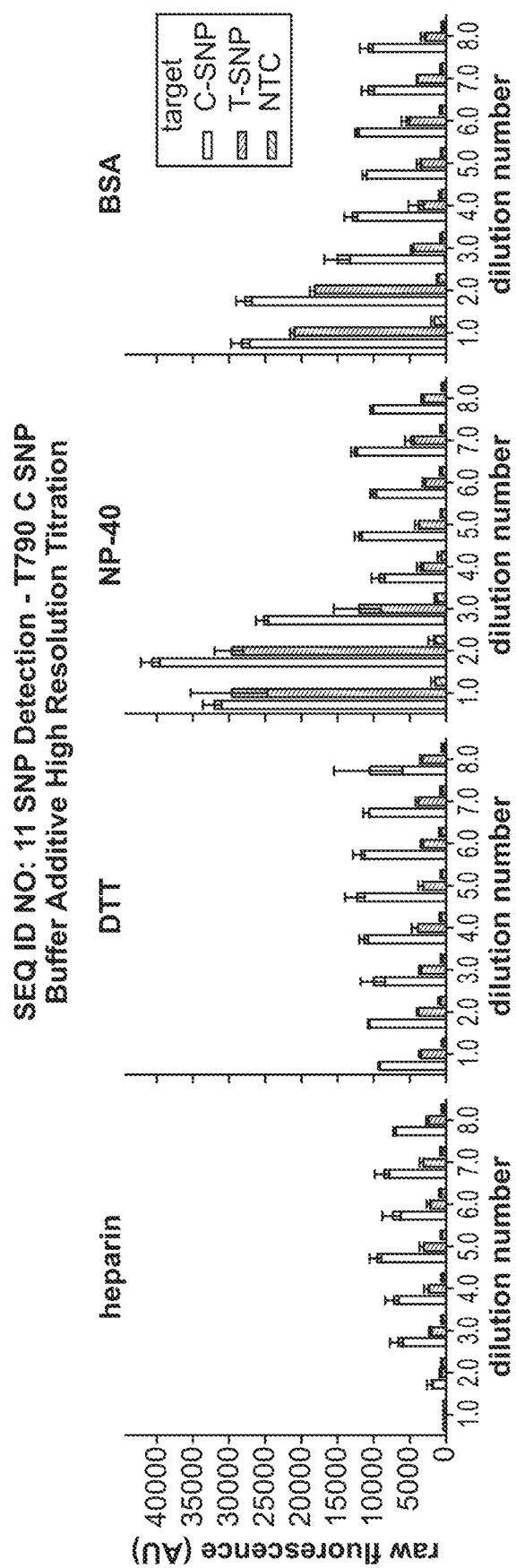
FIG. 5 shows optimization for a number of buffer additives, such as heparin, DTT, NP-40, and BSA (from left to right) over a series of 8 iterative dilutions when detected with a Cas12 variant (SEQ ID NO: 11) and a gRNA of SEQ ID NO: 423.

At FIG. 5, one sees optimization for a number of buffer additives, such as heparin, DTT, NP-40, and BSA (from left to right) over a series of 8 iterative dilutions when detected with a Cas12 variant (SEQ ID NO: 11) and a gRNA of SEQ ID NO: 423.

Accordingly, buffers comprising at least one additive selected from the group consisting of heparin, DTT, NP-40, and BSA, and optionally including in addition or in the alternative triton X, are disclosed herein.

Figure 6:
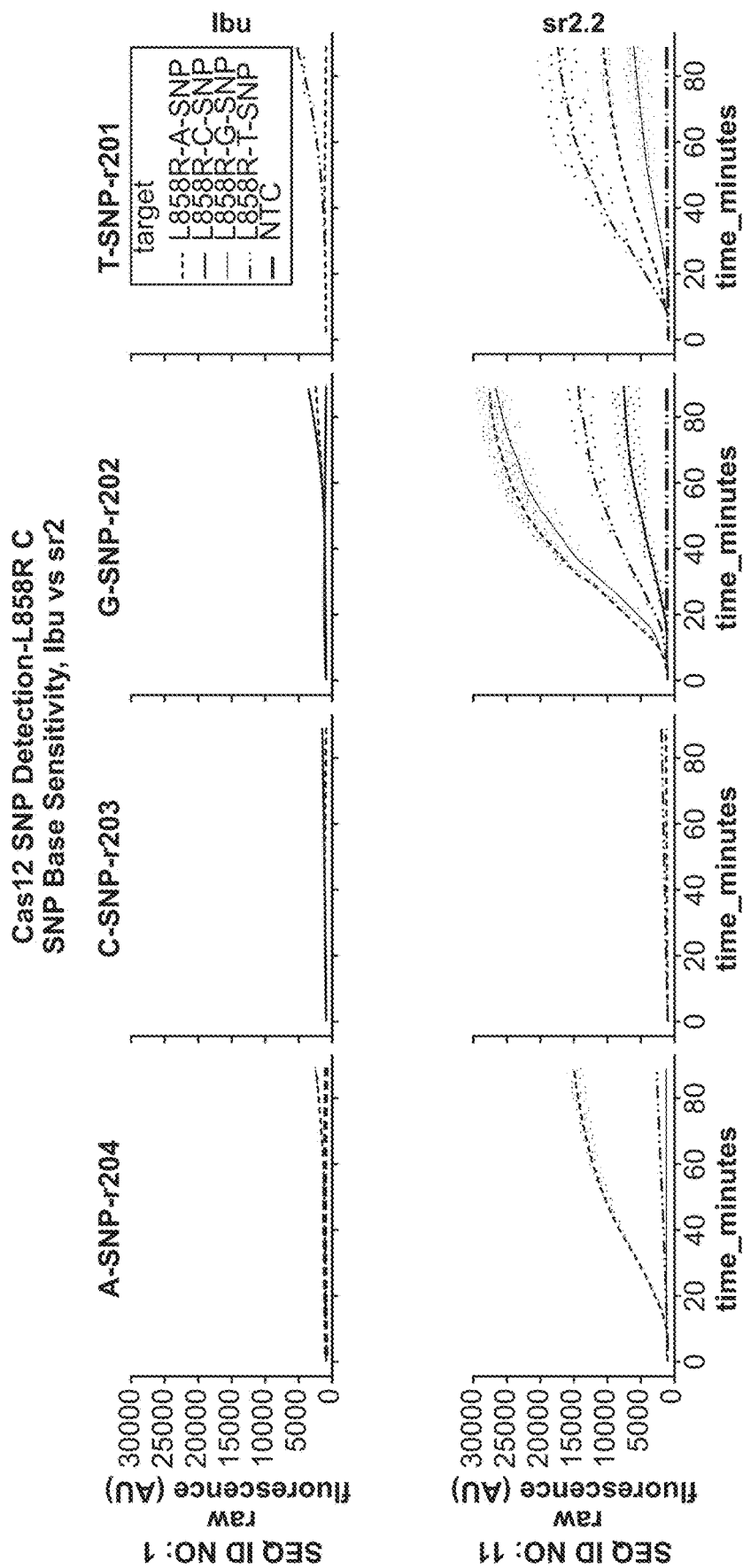
FIG. 6 shows base sensitivity for alleles having bases A, C, G, or T, at a SNP position, for LbCas12a (SEQ ID NO: 1), top, and a representative improved enzyme, a Cas12 variant corresponding to (SEQ ID NO: 11), below. Target sequences corresponding to SEQ ID NO: 431-SEQ ID NO: 438 were detected. The A SNP allele was detected using a gRNA of SEQ ID NO: 427 (GUUUGGUACC-UUUAUUAAUUUCUACUAAGUGUAGAUGGCAGGC-CAAACUGCUGG GU). The C SNP allele was detected using a gRNA of SEQ ID NO: 428 (GUUUGGUACC-UUUAUUAAUUUCUACUAAGUGUAGAUGGCCGGC-CAAACUGCUGG GU). The G SNP allele was detected using a gRNA of SEQ ID NO: 429 (GUUUGGUACC-UUUAUUAAUUUCUACUAAGUGUAGAUGGCGGGC-CAAACUGCUGG GU). The T SNP allele was detected using a gRNA of SEQ ID NO: 430 (GUUUGGUACC-UUUAUUAAUUUCUACUAAGUGUAGAUGGCUGGC-CAAACUGCUGG GU).

At FIG. 6, one sees base sensitivity for each SNP allele, A, C, G, or T, at a SNP position, for LbCas12a (SEQ ID NO: 1), top, and a representative improved enzyme, a Cas12 variant corresponding to (SEQ ID NO: 11), below. One sees substantial improvement over LbCas12a. Target sequences corresponding to SEQ ID NO: 431-SEQ ID NO: 438, provided in TABLE 7 were detected. The A SNP allele was detected using a gRNA of SEQ ID NO: 427. The C SNP allele was detected using a gRNA of SEQ ID NO: 428. The G SNP allele was detected using a gRNA of SEQ ID NO: 429. The T SNP allele was detected using a gRNA of SEQ ID NO: 430.

TABLE 7

Target and Non-Target Strands for SNP Allele Sensitivity

| SEQ ID NO: | Name | Sequence |
|---|---|---|
| SEQ ID NO: 431 | T-SNP Target Strand | TGGTATTCTTTCTCTTCCG CACCCAGCAGTTTGGCCaG CCCAAAATCTGTGATCT |
| SEQ ID NO: 432 | T-SNP Non-Target Strand | AGATCACAGATTTTGGGCt GGCCAAACTGCTGGGTGCG GAAGAGAAAGAATACCA |
| SEQ ID NO: 433 | G-SNP Target Strand | TGGTATTCTTTCTCTTCCG CACCCAGCAGTTTGGCCcG CCCAAAATCTGTGATCT |
| SEQ ID NO: 434 | G-SNP Non-Target Strand | AGATCACAGATTTTGGGCg GGCCAAACTGCTGGGTGCG GAAGAGAAAGAATACCA |
| SEQ ID NO: 435 | C-SNP Target Strand | TGGTATTCTTTCTCTTCCG CACCCAGCAGTTTGGCCgG CCCAAAATCTGTGATCT |
| SEQ ID NO: 436 | C-SNP Non-Target Strand | AGATCACAGATTTTGGGCc GGCCAAACTGCTGGGTGCG GAAGAGAAAGAATACCA |
| SEQ ID NO: 437 | A-SNP Target Strand | TGGTATTCTTTCTCTTCCG CACCCAGCAGTTTGGCCtG CCCAAAATCTGTGATCT |
| SEQ ID NO: 438 | A-SNP Non-Target Strand | AGATCACAGATTTTGGGCa GGCCAAACTGCTGGGTGCG GAAGAGAAAGAATACCA |

Figure 7:
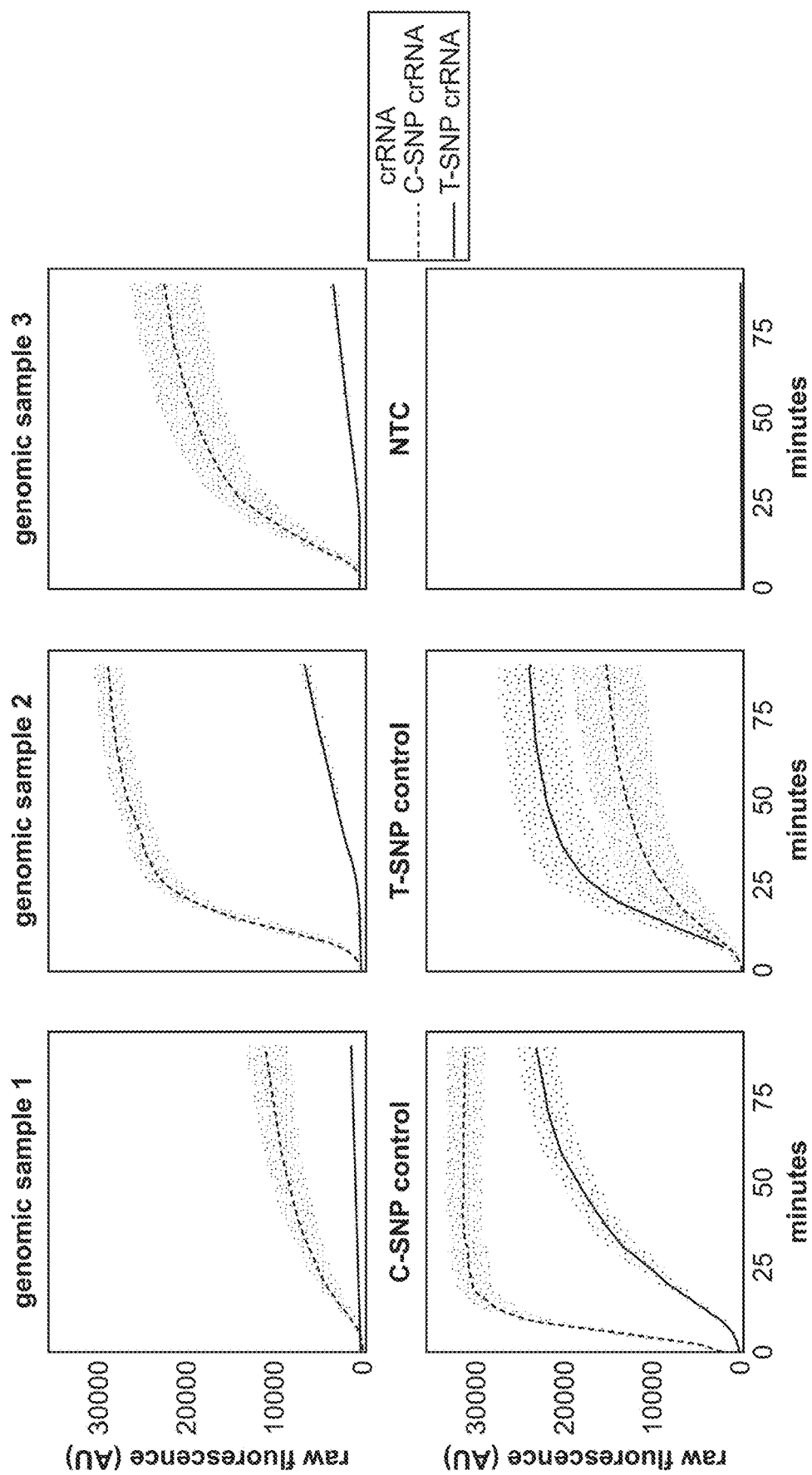
FIG. 7 shows template optimization for an improved enzyme, a Cas12 variant corresponding to SEQ ID NO: 11, as disclosed herein. Templates comprising a C SNP allele (SEQ ID NO: 440, GGGCATGAGCTGCGTGATGA) or a T SNP allele (SEQ ID NO: 441, GGGCATGAGCTGCAT-GATGA) were detected using gRNAs directed to the C SNP (SEQ ID NO: 423) or the T SNP allele (SEQ ID NO: 439, UAAUUUCUACUAAGUGUAGAUUCAUCAUGCAG-CUCAUGCCC). Primers corresponding to SEQ ID NO: 396 and SEQ ID NO: 397 were used to amplify the target sequence and insert a PAM sequence.

At FIG. 7, one sees template optimization for an improved enzyme, a Cas12 variant corresponding to SEQ ID NO: 11, as disclosed herein. Templates comprising a C SNP allele (SEQ ID NO: 440) or a T SNP allele (SEQ ID NO: 441) were detected using gRNAs directed to the C SNP (SEQ ID NO: 423) or the T SNP allele (SEQ ID NO: 439). Primers corresponding to SEQ ID NO: 396 and SEQ ID NO: 397 were used to amplify the target sequence and insert a PAM sequence.

Figure 8:
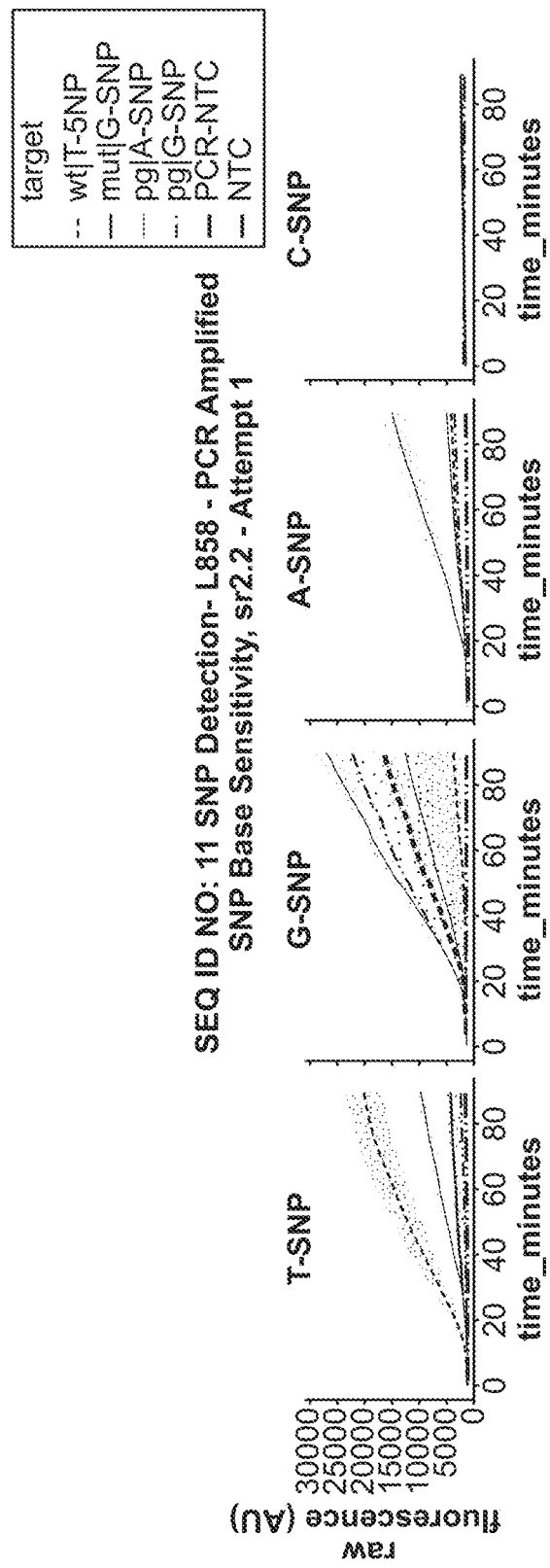
FIG. 8 shows base sensitivity of an improved enzyme, a Cas12 variant corresponding to SEQ ID NO: 11, for each allele having bases A, C, G, or T, for an EGFR SNP as disclosed herein. EGFR target sequences corresponding to SEQ ID NO: 444-SEQ ID NO: 447 were detected. Primers corresponding to SEQ ID NO: 442 (ACCACATGCAG-GAAGGTCAG) and SEQ ID NO: 443 (AGAAGGACTC-CATTGCTGC) were used to amplify the target sequences. The A SNP allele was detected using a gRNA of SEQ ID NO: 427. The C SNP allele was detected using a gRNA of SEQ ID NO: 428. The G SNP allele was detected using a gRNA of SEQ ID NO: 429. The T SNP allele was detected using a gRNA of SEQ ID NO: 430.

At FIG. 8, one sees base sensitivity of an improved enzyme, a Cas12 variant corresponding to SEQ ID NO: 11, for each SNP allele, A, C, G, or T, for an EGFR SNP as disclosed herein. EGFR target sequences corresponding to SEQ ID NO: 444-SEQ ID NO: 447, provided in TABLE 8, were detected. Primers corresponding to SEQ ID NO: 442 and SEQ ID NO: 443 were used to amplify the target sequences. The A SNP allele was detected using a gRNA of SEQ ID NO: 427. The C SNP allele was detected using a gRNA of SEQ ID NO: 428. The G SNP allele was detected using a gRNA of SEQ ID NO: 429. The T SNP allele was detected using a gRNA of SEQ ID NO: 430.

TABLE 8

EGFR Target Sequences

| SEQ ID NO: | Name | Sequence |
|---|---|---|
| SEQ ID NO: 444 | EGFR WT (G-SNP) | TGGTCCCCGCCACCCCCCACCCCCACTTTG CAGATAAACCACATGCAGGAAGGTCAGCCT GGCAAGTCCAGTAAGTTCAAGCCCAGGTCT CAACTGGGCAGCAGAGCTCCTGCTCTTCTT TGTCCTCATATACGAGCACCTCTGGACTTA AAACTTGAGGAACTGGATGGAGAAAAGTTA ATGGTCAGCAGCGGGTTACATCTTCTTTCA TGCGCCTTTCCATTCTTTGGATCAGTAGTC ACTAACGTTCGCCAGCCATAAGTCCTCGAC GTGGAGAGGCTCAGAGCCTGGCATGAACAT GACCCTGAATTCGGATGCAGAGCTTCTTCC CATGATGATCTGTCCCTCACAGCAGGGTCT TCTCTGTTTCAGGGCATGAACTACTTGGAG GACCGTCGCTTGGTGCACCGCGACCTGGCA GCCAGGAACGTACTGGTGAAAACACCGCAG CATGTCAAGATCACAGATTTTGGGCTGGCC AAACTGCTGGGTGCGGAAGAGAAAGAATAC CATGCAGAAGGAGGCAAAGTAAGGAGGTGG CTTTAGGTCAGCCAGCATTTTCCTGACACC AGGGACCAGGCTGCCTTCCCACTAGCTGTA TTGTTTAACACATGCAGGGGAGGATGCTCT CCAGACATTCTGGGTGAGCTCGCAGCAGCT GCTGCTGGCAGCTGGGTCCAGCCAGGGTCT CCTGGTAGTGTGAGCCAGAGCTGCTTTGGG AACAGTACTTGCTGGGACAGTGAATGAGGA TGTTATCCCCAGGTGATCATTAGCAAATGT TAGGTTTCAGTCTCTCCCTGCAGGATATAT AAGTCCCCTTCAATAGCGCAATTGGGAAAG GTCACAGCTGCCTTGGTGGTCCACTGCTGT CAAGGACACCTAAGGAACAGGAAAGGCCCC ATGCGGACCCGAGCTCCCAGGGCTGTCTGT GGCTCGTGGCTGGGACAGGCAGCAATGGAG TCCTTCTCTCCCTTCACTGGCTCGGTTTCT |
| SEQ ID NO: 445 | EGFR A-SNP | TGGTCCCCGCCACCCCCCACCCCCACTTTG CAGATAAACCACATGCAGGAAGGTCAGCCT GGCAAGTCCAGTAAGTTCAAGCCCAGGTCT CAACTGGGCAGCAGAGCTCCTGCTCTTCTT TGTCCTCATATACGAGCACCTCTGGACTTA AAACTTGAGGAACTGGATGGAGAAAAGTTA ATGGTCAGCAGCGGGTTACATCTTCTTTCA TGCGCCTTTCCATTCTTTGGATCAGTAGTC ACTAACGTTCGCCAGCCATAAGTCCTCGAC GTGGAGAGGCTCAGAGCCTGGCATGAACAT GACCCTGAATTCGGATGCAGAGCTTCTTCC CATGATGATCTGTCCCTCACAGCAGGGTCT TCTCTGTTTCAGGGCATGAACTACTTGGAG GACCGTCGCTTGGTGCACCGCGACCTGGCA GCCAGGAACGTACTGGTGAAAACACCGCAG CATGTCAAGATCACAGATTTTGGGCAGGCC AAACTGCTGGGTGCGGAAGAGAAAGAATAC CATGCAGAAGGAGGCAAAGTAAGGAGGTGG CTTTAGGTCAGCCAGCATTTTCCTGACACC AGGGACCAGGCTGCCTTCCCACTAGCTGTA TTGTTTAACACATGCAGGGGAGGATGCTCT CCAGACATTCTGGGTGAGCTCGCAGCAGCT GCTGCTGGCAGCTGGGTCCAGCCAGGGTCT CCTGGTAGTGTGAGCCAGAGCTGCTTTGGG AACAGTACTTGCTGGGACAGTGAATGAGGA TGTTATCCCCAGGTGATCATTAGCAAATGT |

TABLE 8-continued

EGFR Target Sequences

| SEQ ID NO: | Name | Sequence |
|---|---|---|
| | | TAGGTTTCAGTCTCTCCCTGCAGGATATAT AAGTCCCCTTCAATAGCGCAATTGGGAAAG GTCACAGCTGCCTTGGTGGTCCACTGCTGT CAAGGACACCTAAGGAACAGGAAAGGCCCC ATGCGGACCCGAGCTCCCAGGGCTGTCTGT GGCTCGTGGCTGGGACAGGCAGCAATGGAG TCCTTCTCTCCCTTCACTGGCTCGGTTTCT |
| SEQ ID NO: 446 | EGFR T-SNP | TGGTCCCCGCCACCCCCCACCCCCACTTTG CAGATAAACCACATGCAGGAAGGTCAGCCT GGCAAGTCCAGTAAGTTCAAGCCCAGGTCT CAACTGGGCAGCAGAGCTCCTGCTCTTCTT TGTCCTCATATACGAGCACCTCTGGACTTA AAACTTGAGGAACTGGATGGAGAAAAGTTA ATGGTCAGCAGCGGGTTACATCTTCTTTCA TGCGCCTTTCCATTCTTTGGATCAGTAGTC ACTAACGTTCGCCAGCCATAAGTCCTCGAC GTGGAGAGGCTCAGAGCCTGGCATGAACAT GACCCTGAATTCGGATGCAGAGCTTCTTCC CATGATGATCTGTCCCTCACAGCAGGGTCT TCTCTGTTTCAGGGCATGAACTACTTGGAG GACCGTCGCTTGGTGCACCGCGACCTGGCA GCCAGGAACGTACTGGTGAAAACACCGCAG CATGTCAAGATCACAGATTTTGGGCTGGCC AAACTGCTGGGTGCGGAAGAGAAAGAATAC CATGCAGAAGGAGGCAAAGTAAGGAGGTGG CTTTAGGTCAGCCAGCATTTTCCTGACACC AGGGACCAGGCTGCCTTCCCACTAGCTGTA TTGTTTAACACATGCAGGGGAGGATGCTCT CCAGACATTCTGGGTGAGCTCGCAGCAGCT GCTGCTGGCAGCTGGGTCCAGCCAGGGTCT CCTGGTAGTGTGAGCCAGAGCTGCTTTGGG AACAGTACTTGCTGGGACAGTGAATGAGGA TGTTATCCCCAGGTGATCATTAGCAAATGT TAGGTTTCAGTCTCTCCCTGCAGGATATAT AAGTCCCCTTCAATAGCGCAATTGGGAAAG GTCACAGCTGCCTTGGTGGTCCACTGCTGT CAAGGACACCTAAGGAACAGGAAAGGCCCC ATGCGGACCCGAGCTCCCAGGGCTGTCTGT GGCTCGTGGCTGGGACAGGCAGCAATGGAG TCCTTCTCTCCCTTCACTGGCTCGGTTTCT |
| SEQ ID NO: 447 | EGFR C-SNP | TGGTCCCCGCCACCCCCCACCCCCACTTTG CAGATAAACCACATGCAGGAAGGTCAGCCT GGCAAGTCCAGTAAGTTCAAGCCCAGGTCT CAACTGGGCAGCAGAGCTCCTGCTCTTCTT TGTCCTCATATACGAGCACCTCTGGACTTA AAACTTGAGGAACTGGATGGAGAAAAGTTA ATGGTCAGCAGCGGGTTACATCTTCTTTCA TGCGCCTTTCCATTCTTTGGATCAGTAGTC ACTAACGTTCGCCAGCCATAAGTCCTCGAC GTGGAGAGGCTCAGAGCCTGGCATGAACAT GACCCTGAATTCGGATGCAGAGCTTCTTCC CATGATGATCTGTCCCTCACAGCAGGGTCT TCTCTGTTTCAGGGCATGAACTACTTGGAG GACCGTCGCTTGGTGCACCGCGACCTGGCA GCCAGGAACGTACTGGTGAAAACACCGCAG CATGTCAAGATCACAGATTTTGGGCCGGCC AAACTGCTGGGTGCGGAAGAGAAAGAATAC CATGCAGAAGGAGGCAAAGTAAGGAGGTGG CTTTAGGTCAGCCAGCATTTTCCTGACACC AGGGACCAGGCTGCCTTCCCACTAGCTGTA TTGTTTAACACATGCAGGGGAGGATGCTCT CCAGACATTCTGGGTGAGCTCGCAGCAGCT GCTGCTGGCAGCTGGGTCCAGCCAGGGTCT CCTGGTAGTGTGAGCCAGAGCTGCTTTGGG AACAGTACTTGCTGGGACAGTGAATGAGGA TGTTATCCCCAGGTGATCATTAGCAAATGT TAGGTTTCAGTCTCTCCCTGCAGGATATAT AAGTCCCCTTCAATAGCGCAATTGGGAAAG GTCACAGCTGCCTTGGTGGTCCACTGCTGT CAAGGACACCTAAGGAACAGGAAAGGCCCC ATGCGGACCCGAGCTCCCAGGGCTGTCTGT GGCTCGTGGCTGGGACAGGCAGCAATGGAG TCCTTCTCTCCCTTCACTGGCTCGGTTTCT |

Figure 9:
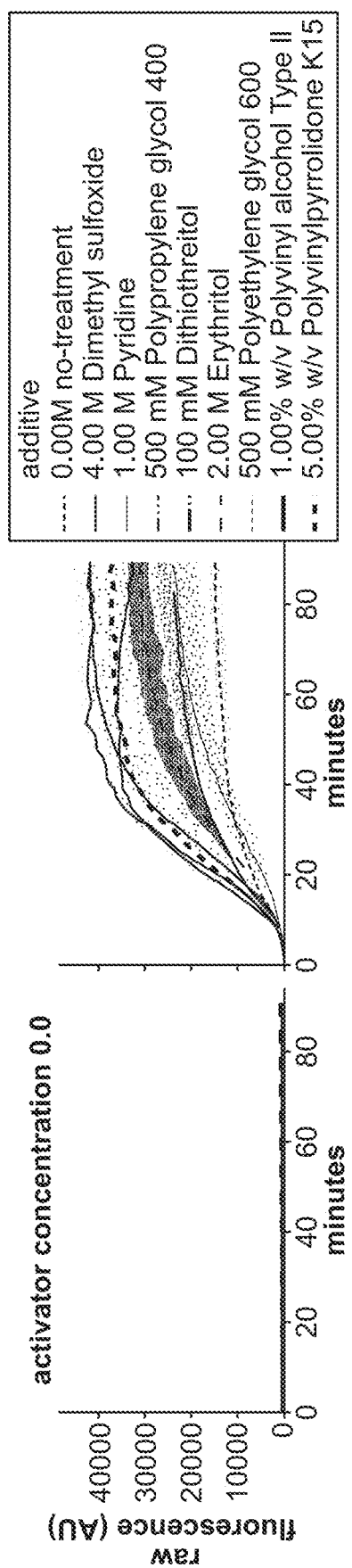
FIG. 9 shows an assessment of buffer additives and their effect on detection using a Cas12 variant (SEQ ID NO: 11).

At FIG. 9, one sees an assessment of buffer additives and their effect on detection using a Cas12 variant (SEQ ID NO: 11). Highest performing additives include 4 M DMSO, 1M Pyridine, 500 mM polypropylene glycol 400, 100 mM dithiothreitol, 2M Erythritol, 500 mM, polyethylene glycol, 1% w/v polyvinyl alcohol type II, and 5% w/v polyvinylpyrrolidone k15.

Accordingly, disclosed here are buffers supplemented or comprising at least one component selected from the list comprising DMSO, Pyridine, polypropylene glycol 400, dithiothreitol, Erythritol, polyethylene glycol, polyvinyl alcohol type II, and 5 polyvinylpyrrolidone k15. Concentrations are contemplated to be about or exactly the values presented above, such as 0, 1, 2, 3, 4, 5, 6, 7, or 8 M, or any interceding value in the range defined thereby, or 0, 100, 200, 300, 400, 500, 600, 700, or 800 mM or any interceding value in the range defined thereby, or 0, 1, 2, 3, 4, 5, 6, 7, or 8% w/v, or any interceding value in the range defined thereby.

Figure 10:
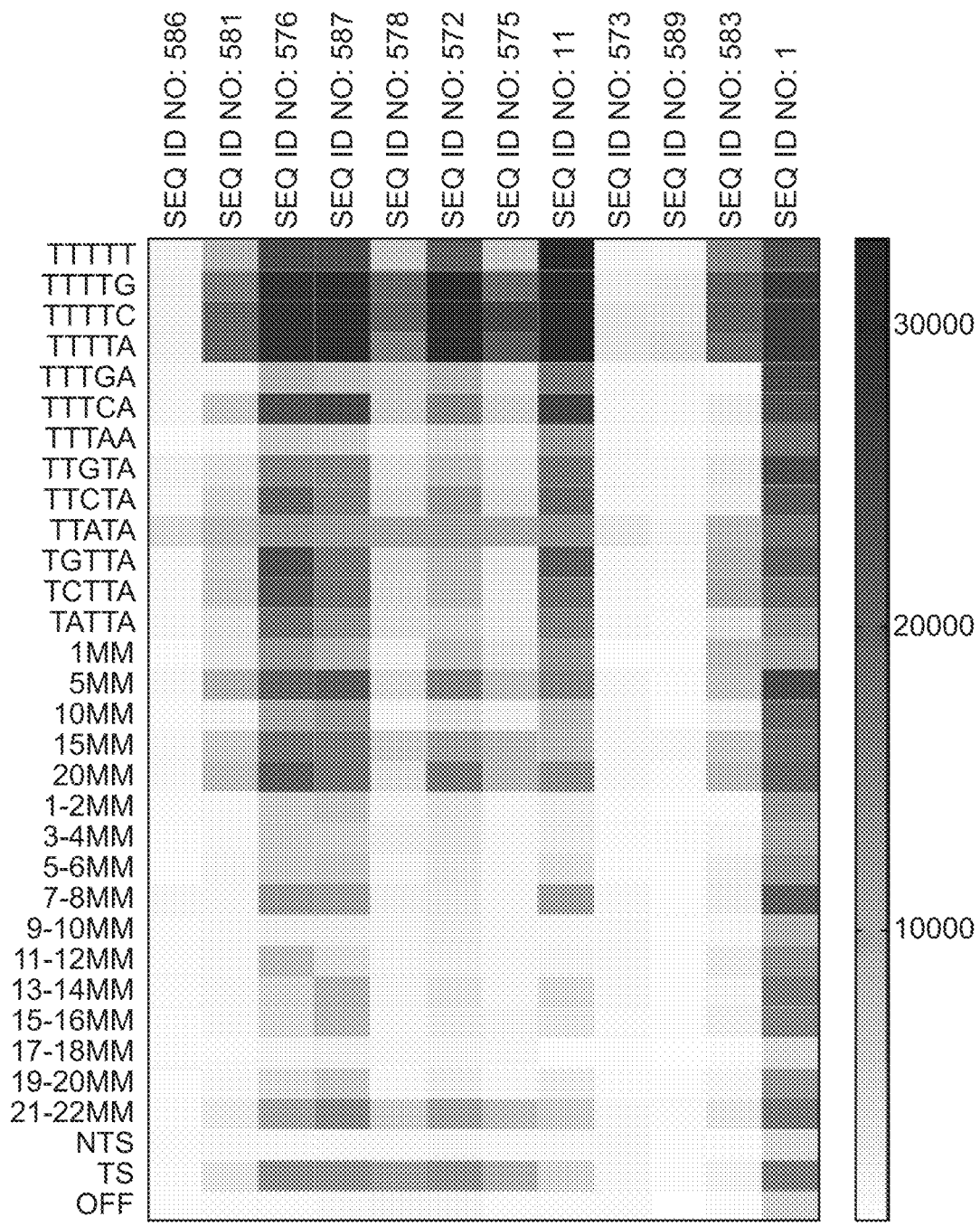
FIG. 10 shows trans cleavage activity of various Cas12 orthologs or other improved enzymes corresponding to SEQ ID NO: 586, SEQ ID NO: 581, SEQ ID NO: 576, SEQ ID NO: 587, SEQ ID NO: 578, SEQ ID NO: 572, SEQ ID NO: 575, SEQ ID NO: 11, SEQ ID NO: 573, SEQ ID NO: 589, and SEQ ID NO: 583, and of LbCas12a (SEQ ID NO: 1) on targets containing various PAMs, double and single mismatched substrates. Target dsDNA was obtained by annealing complementary ssDNA primers with 2:1 ratio of non-target strand to target strand in hybridization buffer (50 mM NaCl, 1 mM Tris pH 8.0, 0.1 mM EDTA) This ensures double-stranded DNA is being detected instead of single-stranded DNA. PAM sequences and the sequences of the target and non-target strands are provided in TABLE 29.

At FIG. 10, one sees trans cleavage activity of various Cas12 orthologs or other improved enzymes corresponding to SEQ ID NO: 586, SEQ ID NO: 581, SEQ ID NO: 576, SEQ ID NO: 587, SEQ ID NO: 578, SEQ ID NO: 572, SEQ ID NO: 575, SEQ ID NO: 11, SEQ ID NO: 573, SEQ ID NO: 589, and SEQ ID NO: 583, and of LbCas12a (SEQ ID NO: 1) on targets containing various PAMs, double and single mismatched substrates. Shading indicates the background subtracted fluorescence signal. NTS, single-stranded non-target substrate, TS, single-stranded target substrate; OFF, an off-target substrate; MM, location of a base mismatch.

Accordingly, disclosed herein are improved enzymes and associated kits and methods relating to enzymes having tolerance for or sensitivity to a particular PAM sequence or to a particular location of a mismatch, or both a PAM sequence and a particular location for a mismatch.

Figure 11:
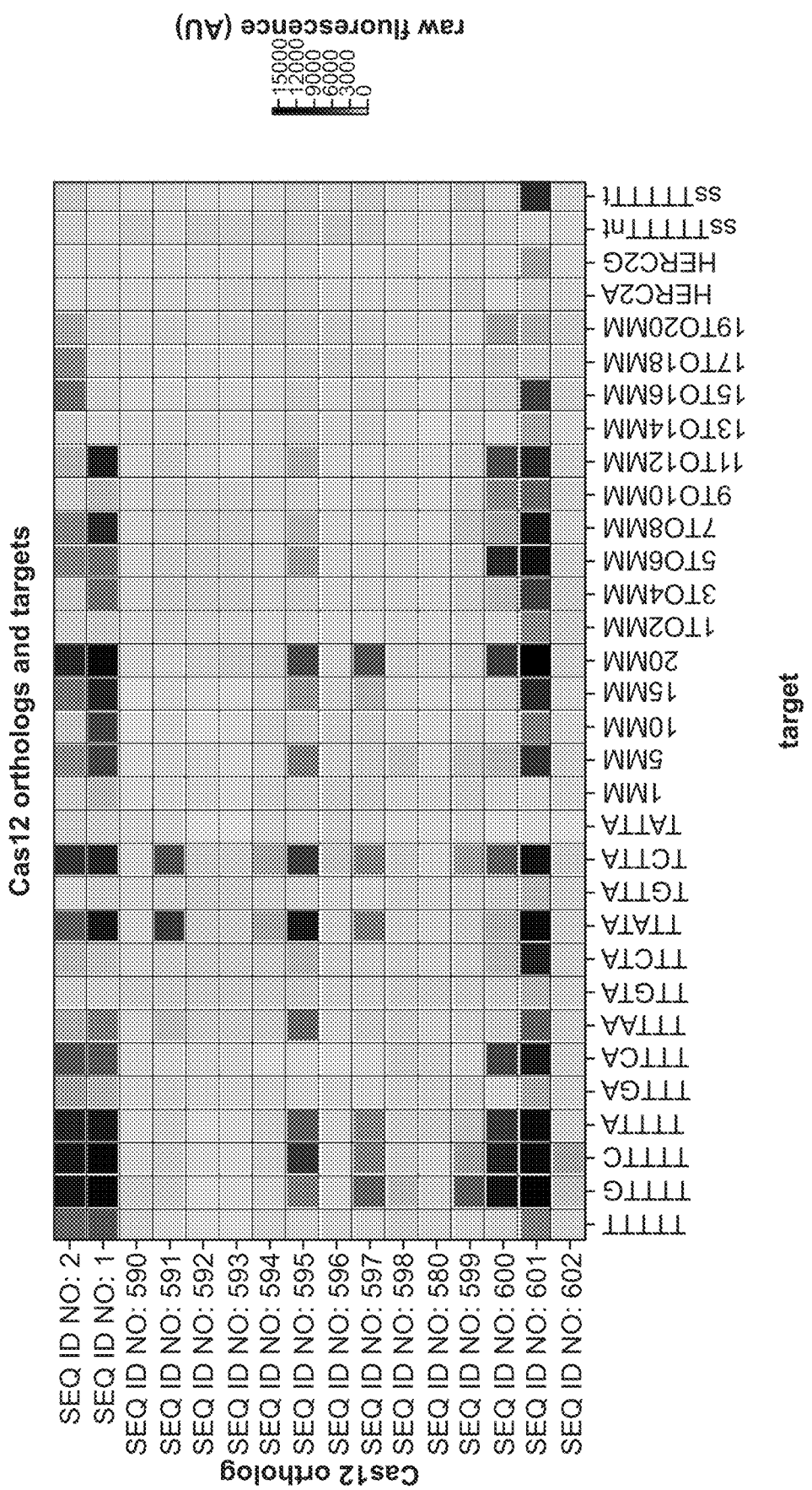
FIG. 11 shows trans cleavage activity of various Cas12 orthologs or other improved enzymes corresponding to SEQ ID NO: 2, SEQ ID NO: 1, SEQ ID NO: 590-SEQ ID NO: 598, SEQ ID NO: 580, and SEQ ID NO: 599-SEQ ID NO: 602 on targets containing various PAMs, double and single mismatched substrates. PAM sequences and the sequences of the target and non-target strands are provided in TABLE 29.

At FIG. 11, one sees trans cleavage activity of various Cas12 orthologs or other improved enzymes corresponding to SEQ ID NO: 2, SEQ ID NO: 1, SEQ ID NO: 590-SEQ ID NO: 598, SEQ ID NO: 580, and SEQ ID NO: 599-SEQ ID NO: 602 on targets containing various PAMs, double and single mismatched substrates. Shading indicates the background subtracted fluorescence signal. JSC142, AsCas12a; JSC143, LbCas12a; pLBH835, MAD7.

Figure 12:
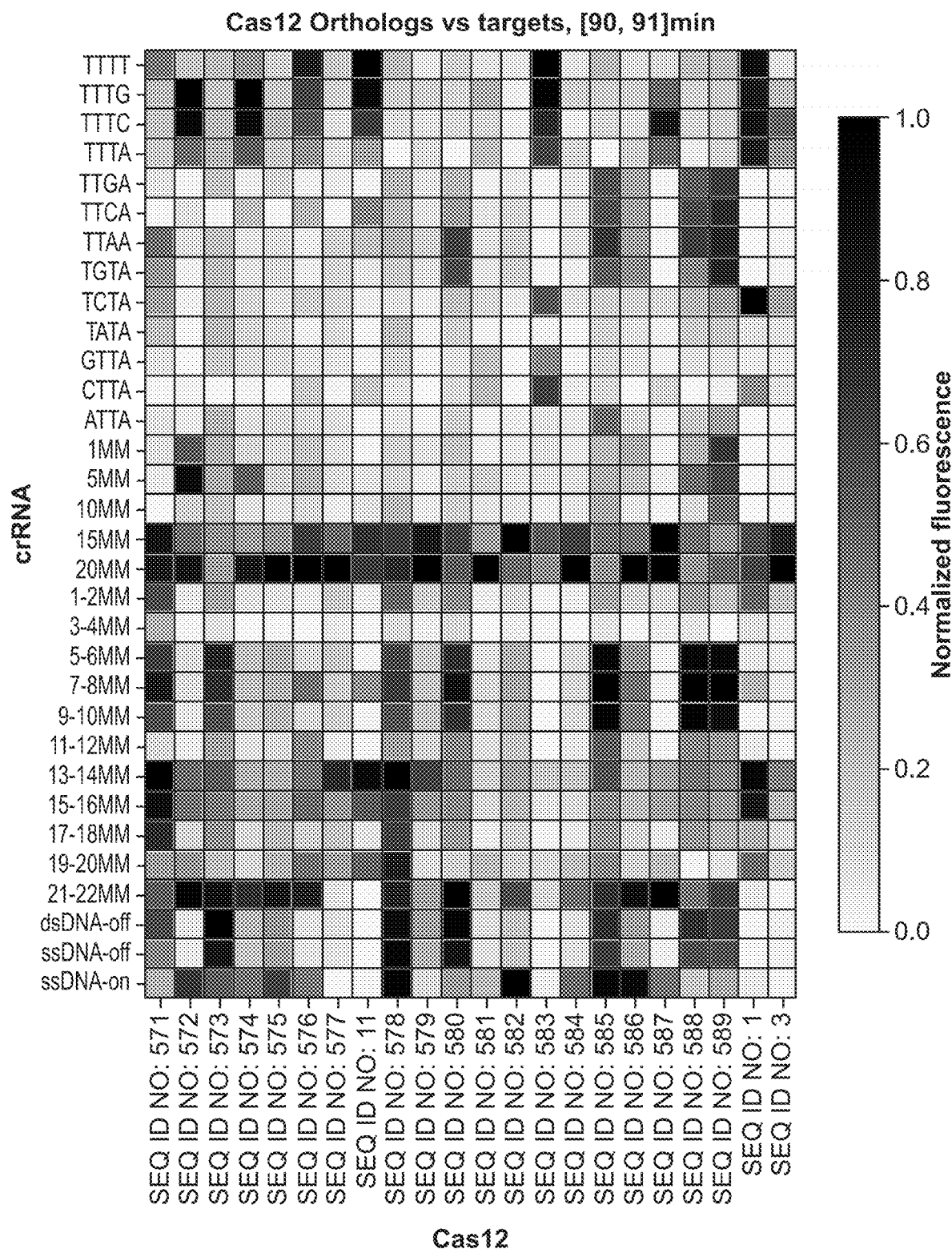
FIG. 12 shows trans cleavage activity of various Cas12 orthologs or other improved enzymes corresponding to SEQ ID NO: 571-SEQ ID NO: 577, SEQ ID NO: 11, SEQ ID NO: 578-SEQ ID NO: 589, SEQ ID NO: 1, and SEQ ID NO: 3 on targets containing various PAMs, double and single mismatched substrates. PAM sequences and the sequences of the target and non-target strands are provided in TABLE 29. Figure discloses SEQ ID NOS 381-393, respectively, in order of appearance.

At FIG. 12, one sees trans cleavage activity of various Cas12 orthologs or other improved enzymes corresponding to SEQ ID NO: 571-SEQ ID NO: 577, SEQ ID NO: 11, SEQ ID NO: 578-SEQ ID NO: 589, SEQ ID NO: 1, and SEQ ID NO: 3 on targets containing various PAMs, double and single mismatched substrates. Shading indicates the background subtracted fluorescence normalized to the maximum value for each.

Figure 13A:
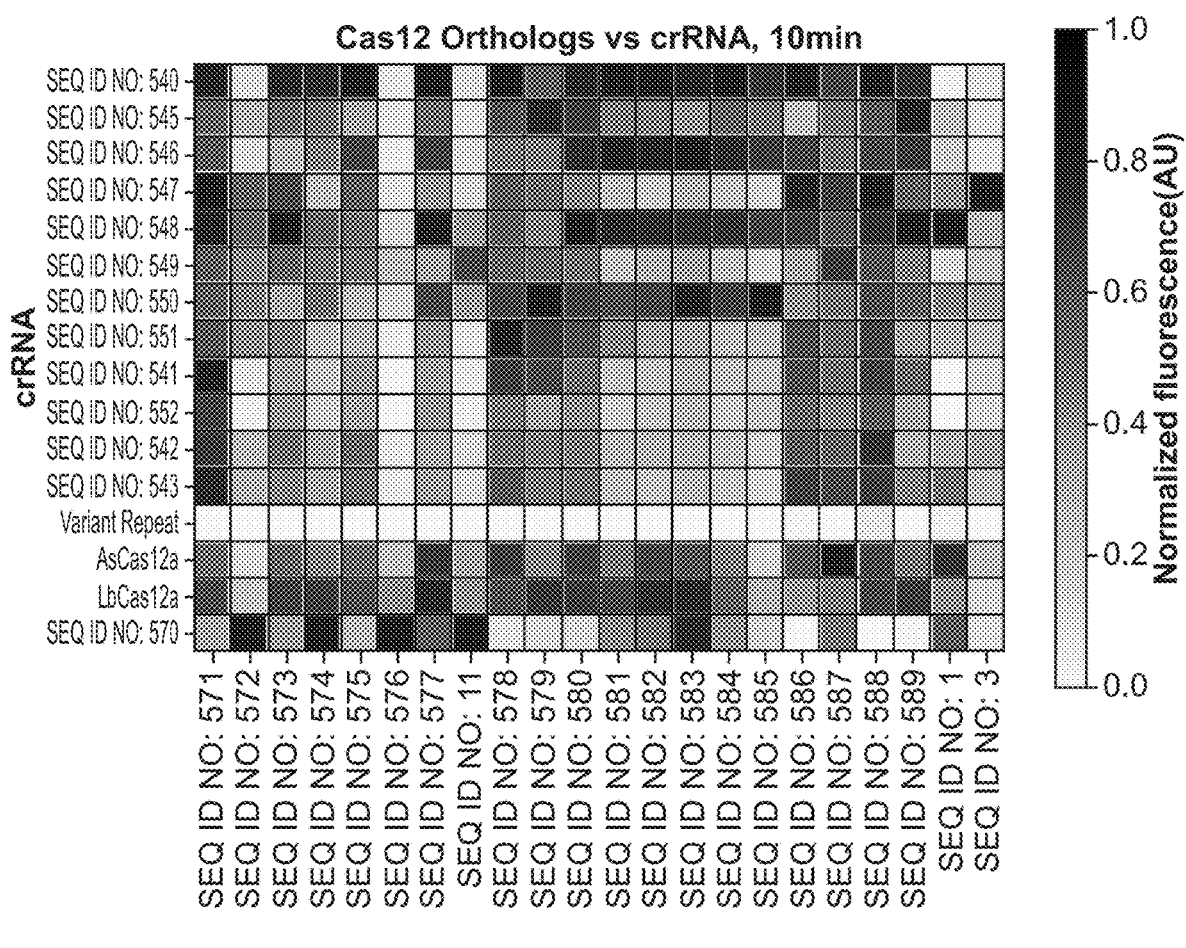
FIG. 13A, FIG. 13B, and FIG. 13C show trans cleavage activity of various Cas12 orthologs corresponding to SEQ ID NO: 571-SEQ ID NO: 577, SEQ ID NO: 11, SEQ ID NO: 578-SEQ ID NO: 589, SEQ ID NO: 1, and SEQ ID NO: 3 on PCR targets containing a TTTA (SEQ ID NO: 384) PAM using various guide RNA repeat sequences. Activity was detected in the presence of different Cas12 variants and different pre-crRNAs corresponding to different Cas12 variants. Sequences of the pre-crRNAs are provided in TABLE 30.
Figure 13B:
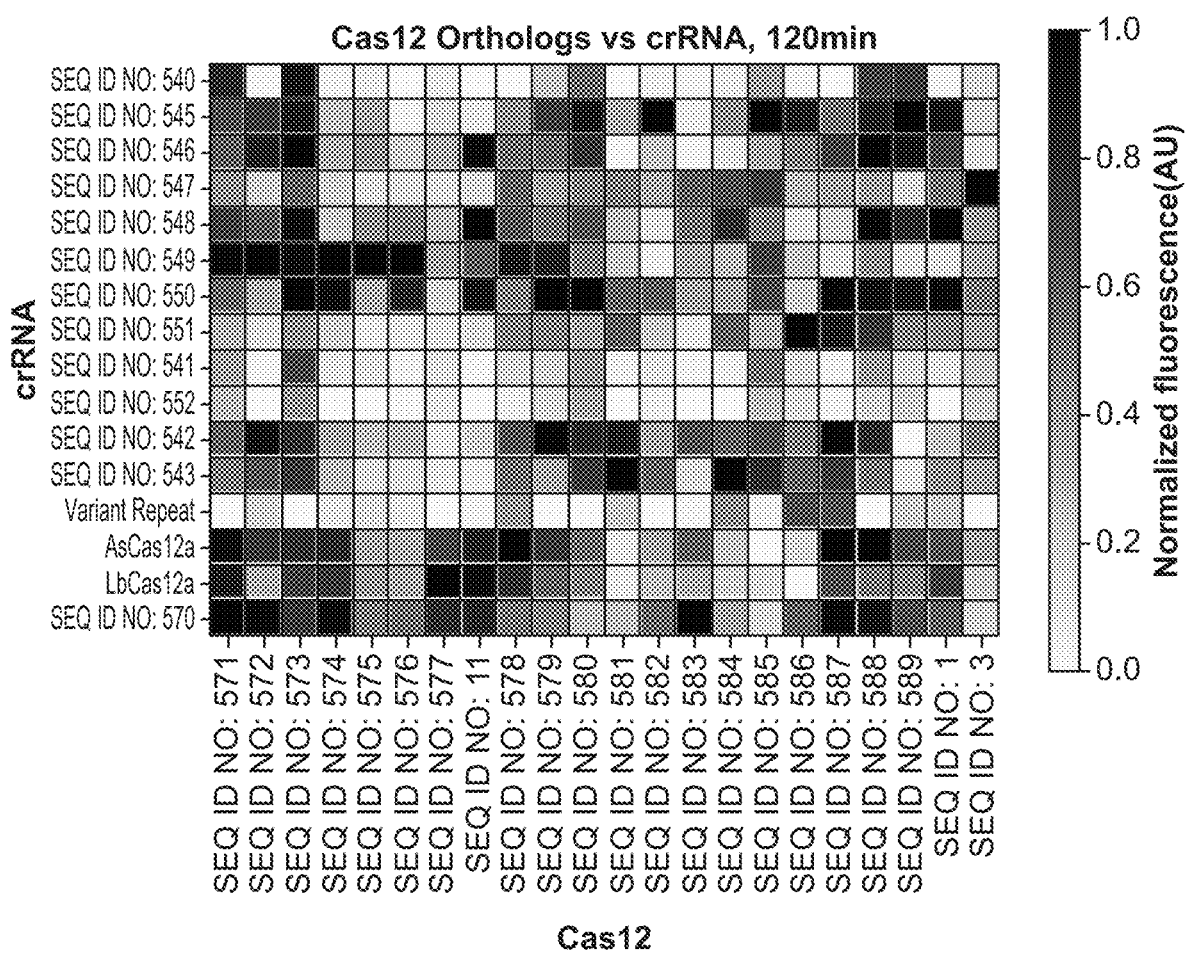
Figure 13C:
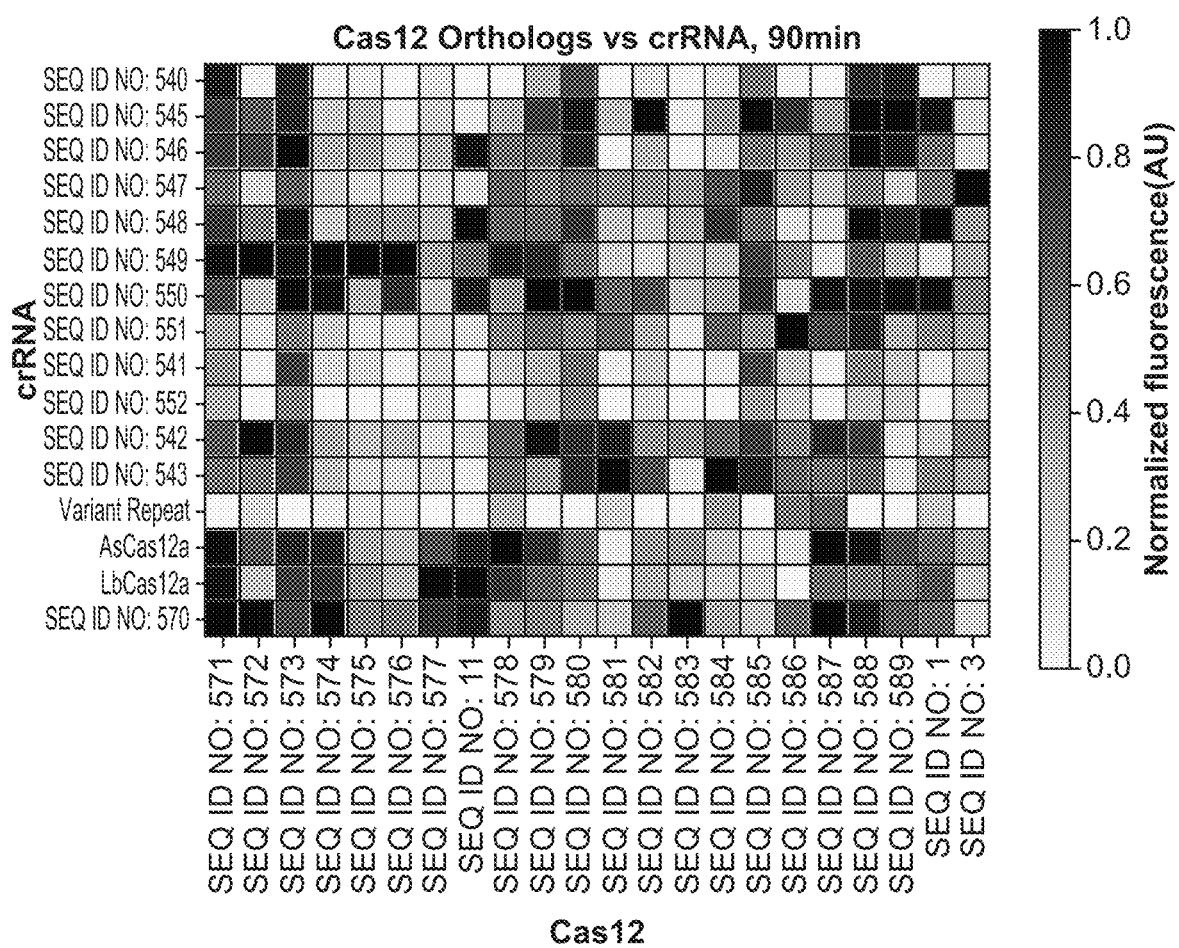

At FIG. 13A, FIG. 13B, and FIG. 13C, one sees trans cleavage activity of various Cas12 orthologs corresponding SEQ ID NO: 571-SEQ ID NO: 577, SEQ ID NO: 11, SEQ ID NO: 578-SEQ ID NO: 589, SEQ ID NO: 1, and SEQ ID NO: 3 on PCR targets containing a TTTA (SEQ ID NO: 384) PAM using various guide RNA repeat sequences. Shading indicates the background subtracted fluorescence normalized to the maximum value for each. Each plot represents an independent replicate. Activity was detected in the presence of different Cas12 variants and different pre-crRNAs corresponding to different Cas12 variants. Sequences of the pre-crRNAs are provided in TABLE 30.

Figure 14:
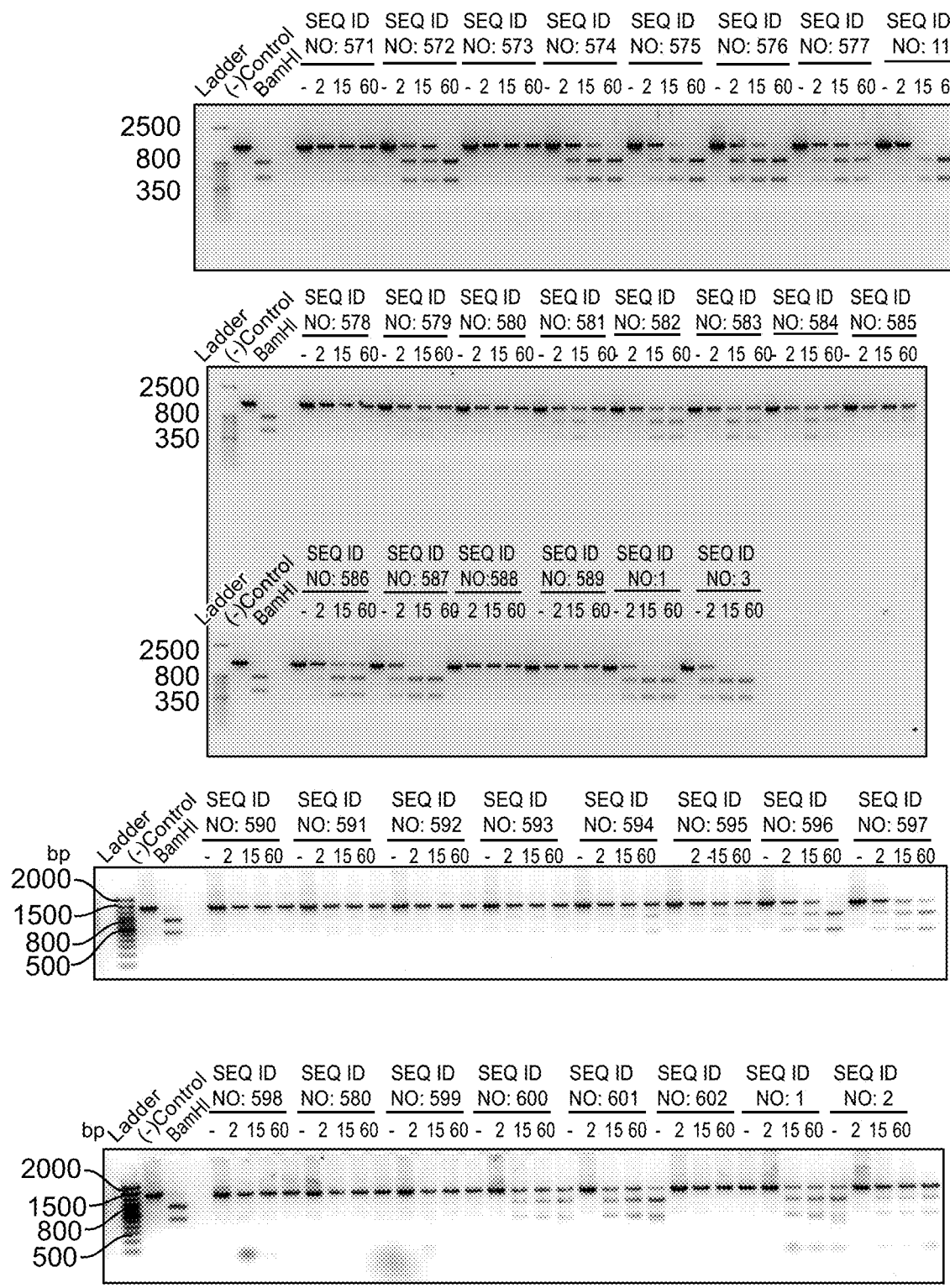
FIG. 14 shows activity of various Cas12 orthologs and other improved enzymes corresponding to SEQ ID NO: 571-SEQ ID NO: 577, SEQ ID NO: 11, SEQ ID NO: 578-SEQ ID NO: 589, SEQ ID NO: 1, SEQ ID NO: 3, SEQ ID NO: 590-SEQ ID NO: 598, SEQ ID NO: 580, SEQ ID NO: 599-SEQ ID NO: 602, and SEQ ID NO: 2 on a target PCR product. The negative control ("(−) control") is PCR product with no Cas12 added. The positive control is cleavage with a BamHI restriction enzyme ("BamHI"). Numbers above each lane correspond to the time in minutes before the reaction was quenched with 10 mM EDTA. Lanes marked with "−" under each Cas12 ortholog correspond to negative control conditions with protein but no crRNA.

At FIG. 14, one sees activity of various Cas12 orthologs and other improved enzymes corresponding to SEQ ID NO: 571-SEQ ID NO: 577, SEQ ID NO: 11, SEQ ID NO: 578-SEQ ID NO: 589, SEQ ID NO: 1, SEQ ID NO: 3, SEQ ID NO: 590-SEQ ID NO: 598, SEQ ID NO: 580, SEQ ID NO: 599-SEQ ID NO: 602, and SEQ ID NO: 2 on a target PCR product. The negative control ("(−) control") is PCR product with no Cas12 added. The positive control is cleavage with a BamHI restriction enzyme ("BamHI"). Numbers above each lane correspond to the time in minutes before the reaction was quenched with 10 mM EDTA. Lanes marked with "−" under each Cas12 ortholog correspond to negative control conditions with protein but no crRNA.

Figure 15:
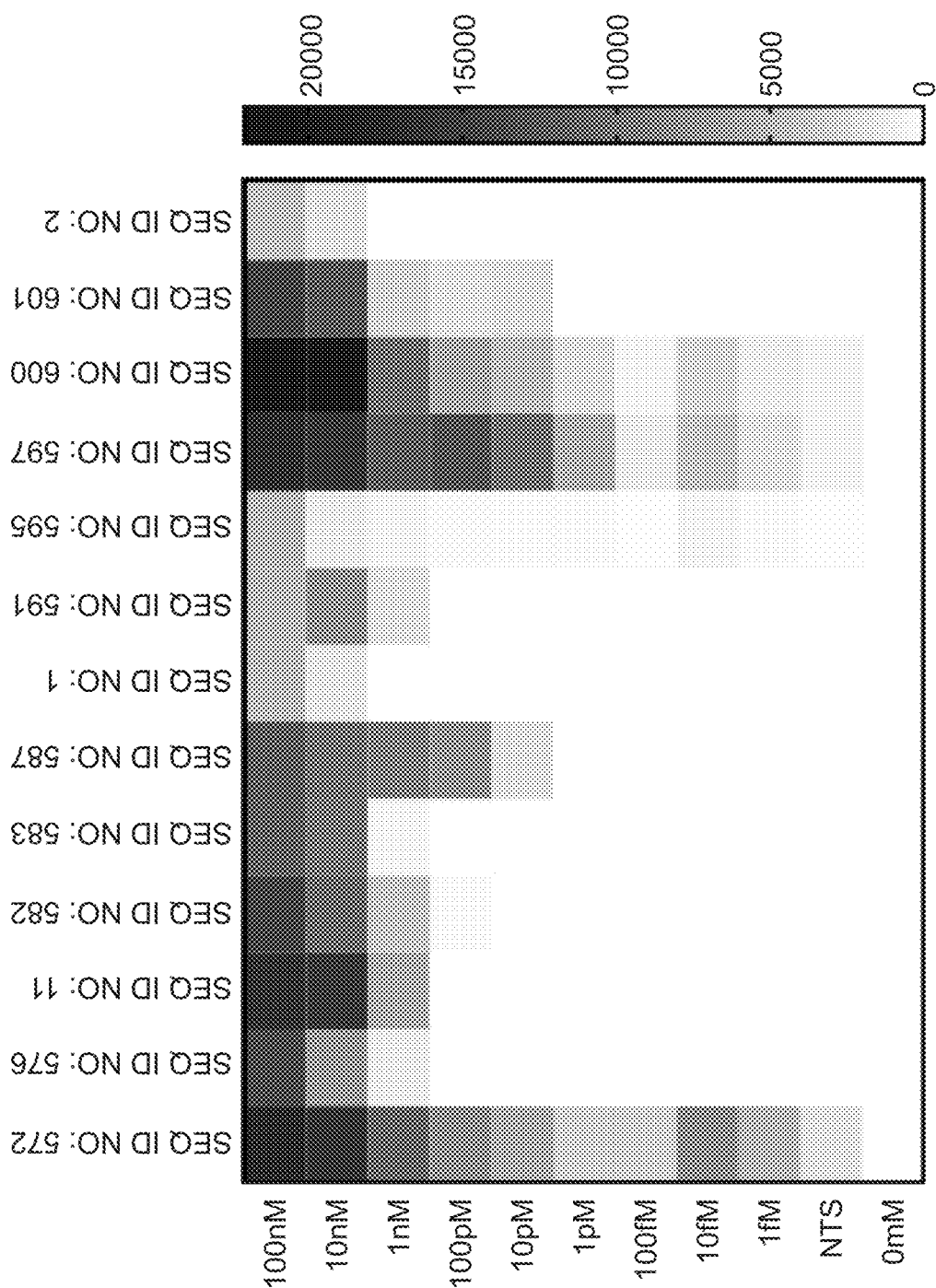
FIG. 15 shows limit of detection (LOD) assay results indicating trans cleavage activity of various Cas12 orthologs or other improved enzymes corresponding to SEQ ID NO: 572, SEQ ID NO: 576, SEQ ID NO: 11, SEQ ID NO: 582, SEQ ID NO: 583, SEQ ID NO: 587, SEQ ID NO: 1, SEQ ID NO: 591, SEQ ID NO: 595, SEQ ID NO: 597, SEQ ID NO: 600, SEQ ID NO: 601, and SEQ ID NO: 2 in the presence of various activator concentrations (shown on the left).

At FIG. 15, one sees limit of detection (LOD) assay results indicating trans cleavage activity of various Cas12 orthologs or other improved enzymes corresponding to SEQ ID NO: 572, SEQ ID NO: 576, SEQ ID NO: 11, SEQ ID NO: 582, SEQ ID NO: 583, SEQ ID NO: 587, SEQ ID NO: 1, SEQ ID NO: 591, SEQ ID NO: 595, SEQ ID NO: 597, SEQ ID NO: 600, SEQ ID NO: 601, and SEQ ID NO: 2 in the presence of various activator concentrations (shown on the left). Shading indicates the background subtracted fluorescence value of after 90 min.

Accordingly, one sees improved enzymes, kits and methods exhibiting sensitivity of as low as 1 nM, 100 pM, 10 pM, 1 pM, 100 fM, 10 fM, or 1 fM, or any number spanned by the range define thereby.

Figure 16A:
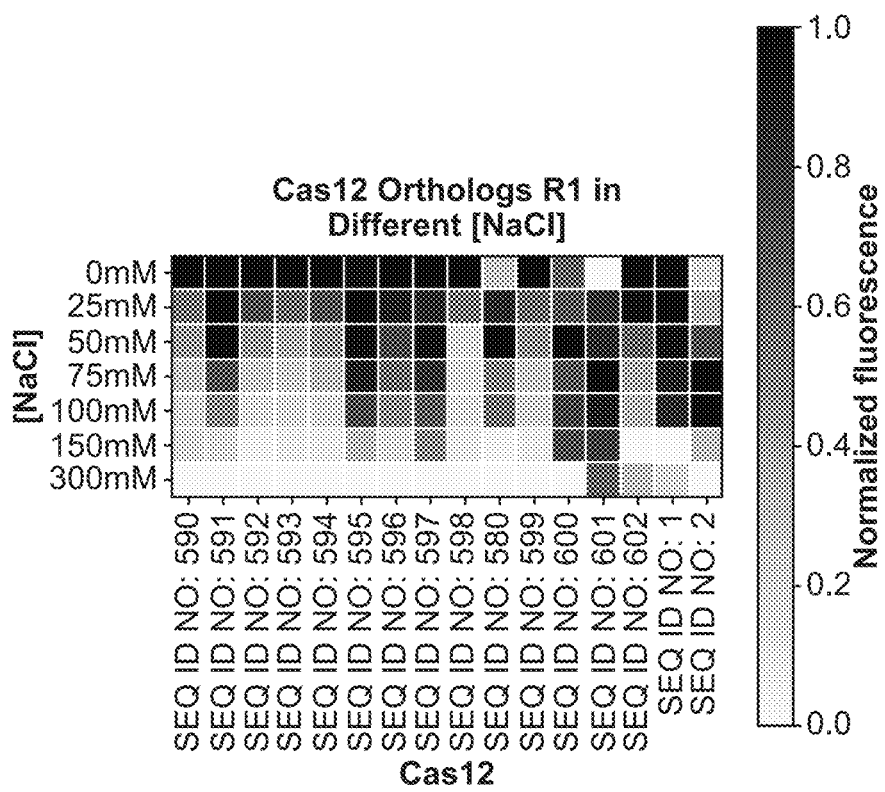
FIG. 16A and FIG. 16B show trans cleavage activity of various Cas12 orthologs corresponding to SEQ ID NO: 590-SEQ ID NO: 598, SEQ ID NO: 580, SEQ ID NO.
Figure 16B:
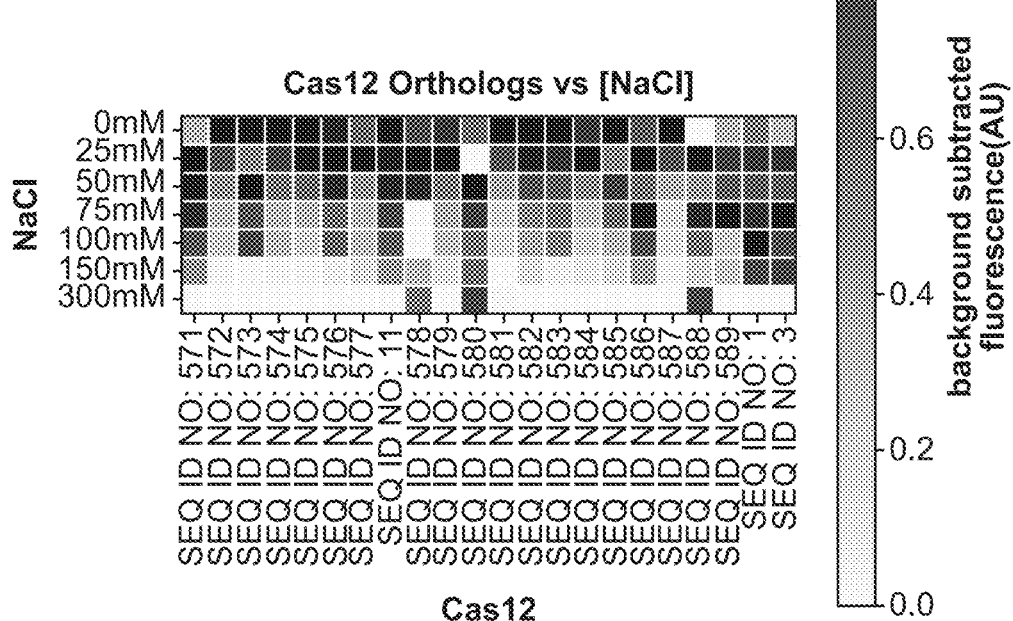

At FIG. 16A and FIG. 16B, one sees trans cleavage activity of various Cas12 orthologs corresponding to SEQ ID NO: 590-SEQ ID NO: 598, SEQ ID NO: 580, SEQ ID NO: 599-SEQ ID NO: 602, and SEQ ID NO: 2 in the presence of various salt concentrations. The shading represents the background subtracted fluorescence normalized to the maximum value for that protein. NaCl concentrations are given for the amount of salt added to the reaction for the added water (eg 0 mM=40 mM final salt concentration).

At FIG. 17A and FIG. 17B, one sees trans cleavage activity of various Cas12 orthologs corresponding to SEQ ID NO: 590-SEQ ID NO: 598, SEQ ID NO: 580, SEQ ID NO: 599-SEQ ID NO: 602, and SEQ ID NO: 2 in the presence of various salt concentrations. The color represents the raw background subtracted fluorescence (no normalization). NaCl concentrations are given for the amount of salt added to the reaction for the added water (e.g., 0 mM=40 mM final salt concentration).

Accordingly, disclosed herein are compositions supporting Cas12 or other improved enzyme activity and having reduced salt concentrations, such as limiting salt concentration to no greater than 10, 20, 37, 75, 150, 300 and 600 mM. Particular improvements are seen at less than 75 nM, at no greater than 40 nM, and at about 10-20 nM. Disclosed herein are compositions having a reduced salt concentration, such as a salt concentration in nM of no greater than 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46,47, 48, 49, 50, 51, 52, 53, 54, 55, 56, 57, 58, 59, 60, 61, 62, 63, 64, 65, 66, 67, 68,669, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 18, 190, 200, 220, 230, 240, 250, 260, 270, 280, 290, or 300.

Numbered Embodiments

The following embodiments recite non-limiting permutations of combinations of features disclosed herein. Other permutations of combinations of features are also contemplated. In particular, each of these numbered embodiments is contemplated as depending from or relating to every previous or subsequent numbered embodiment, independent of their order as listed. 1. A programmable nuclease that elicits maximal reporter activity no more than 60 minutes following contacting to a target template at a target template concentration of 100 nM. 2. The programmable nuclease of embodiment 1, wherein the programmable nuclease comprises a Cas12 protein, a Cas13 protein, or a Cas14 protein. 3. The Cas12 protein of any one of embodiments 1-2, wherein said protein elicits maximal reporter activity following contacting to a target template at least 50% faster than LbCas12 at a given target template concentration. 4. The Cas12 protein of any one of embodiments 1-3, wherein said protein elicits maximal reporter activity following contacting to a target template at least 2× faster than LbCas12 at a given target template concentration. 5. The Cas12 protein of any one of embodiments 1-4, wherein said protein elicits maximal reporter activity following contacting to a target template at least 4× faster than LbCas12 at a given target template concentration. 6. The Cas12 protein of any one of embodiments 1-5, wherein said protein elicits no greater than 33% of maximal reporter activity following contacting to a template differing from a target template by a single base at a template concentration of 100 nM. 7. The Cas12 protein of any one of embodiments 1-6, wherein the protein elicits maximal reporter activity in a composition comprising at least one component selected from the list consisting of acetate, heparin, dithiothreitol (DTT), triton-X, TCEP, BSA, NP-40, imidazole, MOPS, HEPES and DIPSO. 8. The Cas12 protein of any one of embodiments 1-7, wherein the template is unamplified. 9. The Cas12 protein of any one of embodiments 1-8, wherein the template is amplified prior to contacting. 10. The Cas12 protein of any one of embodiments 1-9, wherein the contacting is performed in an activity buffer, wherein the activity buffer comprises 125 mM NaCl, 5 mM MgCl2, 20 mM Tris pH 7.5, and 1% glycerol. 11. The Cas12 protein of any one of embodiments 1-10, wherein the contacting is performed at about 25° C. 12. The Cas12 protein of any one of embodiments 1-11, wherein the contacting is performed at about 37° C. 13. A programmable nuclease reaction buffer comprising at least one component selected from the list consisting of acetate, heparin, dithiothreitol (DTT), triton-X, TCEP, BSA, NP-40, imidazole, MOPS, HEPES and DIPSO. 14. The programmable nuclease of any one of embodiments 1-13, wherein the programmable nuclease comprises a Cas12 protein, a Cas13 protein, or a Cas14 protein. 15. The reaction buffer of any one of embodiments 13-14, wherein the programmable nuclease in said reaction buffer elicits no greater than 33% of maximal reporter activity following contacting to a template differing from a target template by a single base. 16. The reaction buffer of any one of embodiments 13-15, wherein the reaction buffer comprises no greater than 150 mM NaCl. 17. The reaction buffer of any one of embodiments 13-16, wherein the reaction buffer comprises no greater than 100 mM NaCl. 18. The reaction buffer of any one of embodiments 13-17, wherein the reaction buffer comprises no greater than 50 mM NaCl. 19. The reaction buffer of any one of embodiments 13-18, wherein the reaction buffer comprises no greater than 25 mM NaCl. 20. The reaction buffer of any one of embodiments 13-19, wherein the reaction buffer comprises from 0 µg/mL heparin to 100 µg/mL heparin. 21. The reaction buffer of any one of embodiments 13-20, wherein the reaction buffer comprises 0 µg/mL heparin. 22. The reaction buffer of any one of embodiments 13-21, wherein the reaction buffer comprises 50 µg/mL heparin. 23. The reaction buffer of any one of embodiments 13-22, wherein the reaction buffer comprises from 0 mM DTT to 5 mM DTT. 24. The reaction buffer of any one of embodiments 13-23, wherein the reaction buffer comprises 1 mM DTT. 25. The reaction buffer of any one of embodiments 13-24, wherein the reaction buffer comprises from 0 mM to 50 mM Imidazole. 26. The reaction buffer of any one of embodiments 13-25, wherein the reaction buffer comprises 20 mM Imidazole. 27. A programmable nuclease reaction buffer comprising at least one component selected from the list consisting of DMSO, polyvinyl alcohol, polyvinylpyrrolidone, and polypropylene glycol. 28. The programmable nuclease of any one of embodiments 1-27, wherein the programmable nuclease comprises a Cas12 protein, a Cas13 protein, or a Cas14 protein. 29. The reaction buffer of any one of embodiments 13-28, wherein the programmable nuclease in said reaction buffer elicits no greater than 33% of maximal reporter activity following contacting to a no-template control. 30. The reaction buffer of any one of embodiments 13-29, wherein the reaction buffer comprises no greater than 150 mM NaCl. 31. The reaction buffer of any one of embodiments 13-30, wherein the reaction buffer comprises no greater than 100 mM NaCl. 32. The reaction buffer of any one of embodiments 13-31, wherein the reaction buffer comprises no greater than 50 mM NaCl. 33. The reaction buffer of any one of embodiments 13-32, wherein the reaction buffer comprises no greater than 25 mM NaCl. 34. A programmable nuclease that elicits reporter activity no more than 60 minutes following contacting to a target template at a target template concentration of 1 nM in an activity buffer, wherein the activity buffer comprises 125 mM NaCl, 5 mM MgCl2, 20 mM Tris pH 7.5, and 1% glycerol. 35. The programmable nuclease of any one of embodiments 1-34, wherein the programmable nuclease comprises a Cas12 protein, a Cas13 protein, or a Cas14 protein. 36. The Cas12 protein of any one of embodiments 1-35, wherein the Cas12 protein elicits reporter activity no more than 60 minutes following contacting to a target template at a target template concentration of 1 pM. 37. The Cas12 protein of any one of embodiments 1-36, wherein the Cas12 protein elicits reporter activity no more than 60 minutes following contacting to a target template at a target template concentration of 1 fM. 38. A programmable nuclease that exhibits at least 90% target cleavage in no more than 60 minutes. 39. The programmable nuclease of any one of embodiments 1-38, wherein the programmable nuclease comprises a Cas12 protein, a Cas13 protein, or a Cas14 protein. 40. The Cas12 protein of any one of embodiments 1-39, wherein the Cas12 protein exhibits at least 90% target cleavage in no more than 15 minutes. 41. The Cas12 protein of any one of embodiments 1-40, wherein an activity buffer (5×:600 mM NaCl, 25 mM MgCl2, 100 mM Tris pH 7.5, 5% glycerol) exhibits said target cleavage. 42. The Cas12 protein of any one of embodiments 1-41, wherein said cleavage is effected at a Cas12 concentration of from 50 nM to 200 nM. 43. The Cas12 protein of any one of embodiments 1-42, wherein said target cleavage is effected at a Cas12 concentration of 100 nM. 44. The Cas12 protein of any one of embodiments 1-42, wherein said cleavage is effected at a target concentration of from 5 nm to 25 nM. 45. The Cas12 protein of any one of embodiments 1-44, wherein said target cleavage is effected at a target concentration of 15 nM. 46. The Cas12 protein of any one of embodiments 1-45, wherein said target cleavage is effected at a guide RNA concentration of from 50 nM to 200 nM. 47. The Cas12 protein of any one of embodiments 1-46, wherein said target cleavage is effected at a guide RNA concentration of 125 nM. 48. The Cas12 protein of any one of embodiments 1-47, wherein said target cleavage is effected at a temperature of from about 20°

C. to about 40° C. 49. The Cas12 protein of any one of embodiments 1-48, wherein said target cleavage is effected at a temperature of about 25° C. 50. The Cas12 protein of any one of embodiments 1-49, wherein said target cleavage is effected at a temperature of about 37° C. 51. A programmable nuclease that exhibits no more than 10% target cleavage in 60 minutes. 52. The programmable nuclease of any one of embodiments 1-51, wherein the programmable nuclease comprises a Cas12 protein, a Cas13 protein, or a Cas14 protein. 53. The Cas12 protein of any one of embodiments 1-52, wherein the programmable nuclease exhibits said target cleavage in an activity buffer comprising 125 mM NaCl, 5 mM MgCl2, 20 mM Tris pH 7.5, and 1% glycerol. 54. The Cas12 protein of any one of embodiments 1-53, wherein said target cleavage is effected at a Cas12 concentration of 100 nM. 55. The Cas12 protein of any one of embodiments 1-54, wherein said target cleavage is effected at a target concentration of 15 nM. 56. The Cas12 protein of any one of embodiments 1-55, wherein said target cleavage is effected at a guide RNA concentration of 125 nM. 57. The Cas12 protein of any one of embodiments 1-56, wherein said target cleavage is effected at a temperature of about 25° C. 58. The Cas12 protein of any one of embodiments 1-57, wherein said target cleavage is effected at a temperature of about 37° C. 59. A composition comprising a first programmable nuclease population and a second programmable nuclease population, wherein the first programmable nuclease population and the second programmable nuclease population do not recognize a common PAM sequence. 60. The composition of embodiment 59, comprising a third programmable nuclease population, wherein none of the first programmable nuclease population, the second programmable nuclease population, and the third programmable nuclease population recognize a common PAM sequence. 61. The composition of any one of embodiments 59-60, comprising a fourth programmable nuclease population, wherein none of the first programmable nuclease population, the second programmable nuclease population, the third programmable nuclease population, and the fourth programmable nuclease population recognize a common PAM sequence. 62. The composition of any one of embodiments 59-61, wherein the first programmable nuclease, the second programmable nuclease, or a combination thereof comprises a Cas12 protein, a Cas13 protein, or a Cas14 protein. 63. The composition of any one of embodiments 59-62, wherein the third programmable nuclease comprises a Cas12 protein, a Cas13 protein, or a Cas14 protein. 64. The composition of any one of embodiments 59-63, wherein the fourth programmable nuclease comprises a Cas12 protein, a Cas13 protein, or a Cas14 protein. 65. A method for cleaving a unique site of a nucleic acid molecule, comprising designing a guide nucleic acid to cleave the unique site of the nucleic acid molecule and contacting the guide nucleic acid to a programmable nuclease and to the unique site of the nucleic acid molecule, thereby cleaving the unique site of the nucleic acid molecule. 66. The method of any one of embodiments 65-65, wherein a PAM sequence is not considered in the designing of the guide nucleic acid. 67. The method of any one of embodiments 65-66, wherein the programmable nuclease comprises a Cas protein. 68. The method of any one of embodiments 65-67, wherein the Cas protein is Cas14. 69. A method of sequence specific cleavage of a nucleic acid molecule in a sample comprising contacting to a first PAM independent nuclease to a flank on one side of a cleavage site the nucleic acid molecule and a second PAM independent nuclease to a flank on the other side of the cleavage site of the nucleic acid molecule. 70. The method of any one of embodiments 65-69, further comprising contacting the sample to a DNA fragment for sequence specific break repair. 71. The method of any one of embodiments 65-70, wherein the PAM independent nuclease is a Cas protein. 72. The method of any one of embodiments 65-71, wherein the Cas protein is a nickase. 73. The method of any one of embodiments 65-72, wherein the Cas protein is Cas14. 74. A method of detecting a presence or an absence of a target nucleic acid in a sample, the method comprising: contacting a first volume to a second volume, wherein the first volume comprises the sample and the second volume comprises: i) a guide nucleic acid having at least 10 nucleotides reverse complementary to a target nucleic acid in the sample; and ii) a programmable nuclease activated upon binding of the guide nucleic acid to the target nucleic acid; iii) a reporter comprising a nucleic acid and a detection moiety, wherein the second volume is at least 4-fold greater than the first volume; and detecting the presence or the absence of the target nucleic acid by measuring a signal produced by cleavage of the nucleic acid of the reporter, wherein cleavage occurs when the programmable nuclease is activated. 75. The method of any one of embodiments 65-74, wherein the first volume comprises from 1 µL to 10 µL. 76. The method of any one of embodiments 65-75, wherein the first volume comprises from 1 µL to 5 µL. 77. The method of any one of embodiments 65-76, wherein the first volume comprises about 2 µL. 78. The method of any one of embodiments 65-77, wherein the first volume comprises about 4 µL. 79. The method of any one of embodiments 65-78, wherein the second volume comprises from 5 µL to 40 µL. 80. The method of any one of embodiments 65-79, wherein the second volume comprises from 10 µL to 30 µL. 81. The method of any one of embodiments 65-80, wherein the second volume comprises about 20 µL. 82. The method of any one of embodiments 65-81, wherein the second volume comprises about 30 µL. 83. The method of any one of embodiments 65-82, wherein the first volume comprises one or more of a buffer for cell lysis, a buffer for amplification, a primer, a polymerase, target nucleic acid, a non-target nucleic acid, a single-stranded DNA, a double-stranded DNA, a salt, a buffering agent, an NTP, a dNTP, or any combination thereof 84. The method of any one of embodiments 65-83, wherein the sample is a biological sample comprising blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. 85. The method of any one of embodiments 65-84, wherein the programmable nuclease is a programmable Type V CRISPR/Cas enzyme. 86. The method of any one of embodiments 65-85, wherein the programmable Type V CRISPR/Cas enzyme is a programmable Cas12 nuclease. 87. The method of any one of embodiments 65-86, wherein the programmable Cas12 nuclease is Cas12a, Cas12b, Cas12c, Cas12d, or Cas12e. 88. The method of any one of embodiments 65-87, wherein the programmable Type V CRISPR/Cas enzyme is a programmable Cas14 nuclease. 89. The method of any one of embodiments 65-88, wherein the programmable Cas14 nuclease is Cas14a, Cas14b, Cas14c, Cas14d, Cas14e, Cas14f, Cas14g, or Cas14h. 90. The method of any one of embodiments 65-89, wherein the programmable nuclease is a programmable Type VI CRISPR/Cas enzyme. 91. The method of any one of embodiments 65-90, wherein the programmable Type VI CRISPR/Cas enzyme is a programmable Cas13 nuclease. 92. The method of any one of embodiments 65-91, wherein the programmable Cas13 nuclease is Cas13a, Cas13b, Cas13c, Cas13d, or Cas13e. 93. A method of designing a plurality of primers for amplification of a target nucleic acid, the method comprising: providing a target nucleic acid, wherein a guide nucleic acid hybridizes to the target nucleic acid and wherein at least 60% of a sequence of the target nucleic acid is between an F1c region and a B1 region or between an F1 and a B1c region; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region. 94. A method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the guide nucleic acid hybridizes to the target nucleic acid and wherein at least 60% of a sequence of the target nucleic acid is between the F1c region and a B1 region or between an F1 region and the B1c region; a reporter; and a programmable nuclease that cleaves the reporter when complexed with the guide nucleic acid upon hybridization of the guide nucleic acid to the target nucleic acid; and measuring a detectable signal produced by cleavage of the reporter, wherein the measuring provides for detection of the target nucleic acid in the sample. 95. The method of any one of embodiments 65-94, wherein the sequence between the F1c region and the B1 region or the sequence between the B1c region and the F1 region is at least 50% reverse complementary to the guide nucleic acid sequence. 96. The method of any one of embodiments 65-95, wherein the guide nucleic acid sequence is reverse complementary to no more than 50% of the forward inner primer, the backward inner primer, or a combination thereof 97. The method of any one of embodiments 65-96, wherein the guide nucleic acid does not hybridize to the forward inner primer and the backward inner primer. 98. The method of any one of embodiments 65-97, wherein a protospacer adjacent motif (PAM) or a protospacer flanking site (PFS) is 3' of the target nucleic acid. 99. The method of any one of embodiments 65-98, wherein a protospacer adjacent motif (PAM) or a protospacer flanking site (PFS) is 3' of the B1 region and 5' of the F1c region or the protospacer adjacent motif (PAM) or a protospacer flanking site (PFS) is 3' of the F1 region and 5' of the B1c region. 100. The method of any one of embodiments 65-99, wherein the 3' end of the target nucleic acid is 5' of the 5' end of the F3c region or the 3' end of the target nucleic acid is 5' of the 5' end of the B3c region. 101. The method of any one of embodiments 65-100, wherein the 3' end of the target nucleic acid is 5' of the 5' end of the F2c region or 3' end of the target nucleic acid is 5' of the 5' end of the B2c region. 102. The method of any one of embodiments 65-101, wherein the target nucleic acid is between the F1c region and the B1 region and the 3' end of the target nucleic acid is 5' of the 3' end of the F2c region, or wherein the target nucleic acid is between the B1c region and the F1 region and the 3' end of the target nucleic acid is 5' of the 3' end of the B2c region. 103. The method of any one of embodiments 65-102, wherein the guide nucleic acid has a sequence reverse complementary to no more than 50% of the forward inner primer, the backward inner primer, the forward outer primer, the backward outer primer, or any combination thereof 104. The method of any one of embodiments 65-103, wherein the guide nucleic acid sequence does not hybridize to the forward inner primer, the backward inner primer, the forward outer primer, the backward outer primer, or any combination thereof 105. The method of any one of embodiments 65-104, wherein the guide nucleic acid sequence has a sequence reverse complementary to no more than 50% of a sequence of an F3c region, an F2c region, the F1c region, the B1c region, an B2c region, an B3c region, or any combination thereof 106. The method of any one of embodiments 65-105, wherein the guide nucleic acid sequence does not hybridize to a sequence of an F3c region, an F2c region, the F1c region, the B1c region, an B2c region, an B3c region, or any combination thereof 107. A method of designing a plurality of primer for amplification of a target nucleic acid, the method comprising: providing the target nucleic acid comprising a sequence between a B2 region and a B1 region or between an F2 region and an F1 region that hybridizes to a guide nucleic acid; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region. 108. A method of designing a plurality of primer for amplification of a target nucleic acid, the method comprising: providing the target nucleic acid comprising a sequence between a F1c region and an F2c region or between a B1c region and a B2c region that hybridizes to a guide nucleic acid; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region. 109. A method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the target nucleic acid comprises a sequence between a B2 region and a B1 region or between the F2 region and an F1 region that hybridizes to the guide nucleic acid; a reporter; and a programmable nuclease that cleaves the reporter when complexed with the guide nucleic acid upon hybridization of the guide nucleic acid to the target nucleic acid; and measuring a detectable signal produced by cleavage of the reporter, wherein the measuring provides for detection of the target nucleic acid in the sample. 110. A method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the target nucleic acid comprises a sequence between the F1c region and an F2c region or between the B1c region and a B2c region that hybridizes to the guide nucleic acid; a reporter; and a programmable nuclease that cleaves the reporter when complexed with the guide nucleic acid upon hybridization of the guide nucleic acid to the target nucleic acid; and measuring a detectable signal produced by cleavage of the reporter, wherein the measuring provides for detection of the target nucleic acid in the sample. 111. The method of any one of embodiments 65-110, wherein a protospacer adjacent motif (PAM) or a protospacer flanking site (PFS) is 3' of the B2 region and 5' of the B1 region or the protospacer adjacent motif (PAM) or a protospacer flanking site (PFS) is 3' of the F2 region and 5' of the F1 region. 112. The method of any one of embodiments 65-111, wherein a protospacer adjacent motif (PAM) or a protospacer flanking site (PFS) is 3' of the B1c region and 5' of the B2c region or the protospacer adjacent motif (PAM) or a protospacer flanking site (PFS) is 3' of the F1c region and 5' of the F2c region. 113. The method of any one of embodiments 65-112, wherein a protospacer adjacent motif (PAM) or a protospacer flanking site (PFS) is 3' of the target nucleic acid. 114. The method of any one of embodiments 65-113, wherein the PAM and the PFS are 5' of the 5' end of the F1c region, 5' of the 5' end of the B1c region, 3' of the 3' end of the F3 region, 3' of the 3' end of the B3 region, 3' of the 3' end of the F2 region, 3' of the 3' end of the B2 region, or any combination thereof 115. The method of any one of embodiments 65-114, wherein the PAM and the PFS do not overlap the F2 region, the B3 region, the F1c region, the F2 region, the B1c region, the B2 region, or any combination thereof 116. The method of any one of embodiments 65-115, wherein the PAM and the PFS do not hybridize to the forward inner primer, the backward inner primer, the forward outer primer, the backward outer primer, or any combination thereof 117. The method of any one of embodiments 65-116, wherein the plurality of primers further comprises a loop forward primer. 118. The method of any one of embodiments 65-117, wherein the plurality of primers further comprises a loop backward primer. 119. The method of any one of embodiments 65-118, wherein the loop forward primer is between an F1c region and an F2c region. 120. The method of any one of embodiments 65-119, wherein the loop backward primer is between a B1c region and a B2c region. 121. The method of any one of embodiments 65-120, wherein the target nucleic acid comprises a single nucleotide polymorphism (SNP). 122. The method of any one of embodiments 65-121, wherein the single nucleotide polymorphism (SNP) comprises a HERC2 SNP, an ALDH2 SNP, an EGFR SNP, a PNPLA3 SNP, a CYP2C19*2 SNP, a PAH SNP, a CFTR SNP, a β-globin SNP, a DMD SNP, a APOB SNP, a LDLR SNP, a LDLRAP1 SNP, a PCSK9 SNP, a NF1 SNP, a PKD1 SNP, a DMPK SNP, a F9 SNP, a F8 SNP, a PKD1 SNP, a PHEX SNP, or a MECP SNP. 123. The method of any one of embodiments 65-122, wherein the single nucleotide polymorphism (SNP) is associated with an increased risk or decreased risk of cancer. 124. The method of any one of embodiments 65-123, wherein the target nucleic acid comprises a single nucleotide polymorphism (SNP), and wherein the detectable signal is higher in the presence of a guide nucleic acid that is 100% complementary to the target nucleic acid comprising the single nucleotide polymorphism (SNP) than in the presence of a guide nucleic acid that is less than 100% complementary to the target nucleic acid comprising the single nucleotide polymorphism (SNP). 125. The method of any one of embodiments 65-124, wherein the plurality of primers and the guide nucleic acid are present together in a sample comprising the target nucleic acid. 126. The method of any one of embodiments 65-125, wherein the amplifying and the contacting the sample to the guide nucleic acid occurs at the same time. 127. The method of any one of embodiments 65-126, wherein the amplifying and the contacting the sample to the guide nucleic acid occur at different times. 128. The method of any one of embodiments 65-127, wherein the method further comprises providing a polymerase, a dATP, a dTTP, a dGTP, a dCTP, or any combination thereof 129. A method of assaying for a target nucleic acid in a sample, comprising: contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid, wherein the sample comprises at least one nucleic acid comprising at least 50% sequence identity to the segment of the target nucleic acid; and assaying for cleavage of at least one detector nucleic acids of a population of detector nucleic acids, wherein the cleavage indicates a presence of the target nucleic acid in the sample and wherein absence of the cleavage indicates an absence of the target nucleic acid in the sample. 130. The method of embodiment 129, wherein the target nucleic acid is from 0.05% to 20% of total nucleic acids in the sample. 131. The method of any one of embodiments 129-130, wherein the target nucleic acid is from 0.1% to 10% of total nucleic acids in the sample. 132. The method of any one of embodiments 129-131, wherein the target nucleic acid is from 0.1% to 5% of total nucleic acids in the sample. 133. The method of any one of embodiments 129-132, wherein the contacting is performed in a buffer comprising heparin and NaCl. 134. The method of any one of embodiments 129-133, wherein the NaCl is from 50 mM NaCl to 200 mM NaCl. 135. The method of any one of embodiments 129-134, wherein the NaCl is 100 mM NaCl. 136. The method of any one of embodiments 129-135, wherein the heparin is from 20 µg/ml heparin to 100 µg/ml heparin. 137. The method any one of embodiments 129-136, wherein the heparin is 50 µg/ml heparin. 138. The method of any one of embodiments 129-137, wherein the sample comprises at least one nucleic acid comprising at least 80% sequence identity to the segment of the target nucleic acid. 139. The method of any one of embodiments 129-138, wherein the sample comprises at least one nucleic acid comprising at least 90% sequence identity to the segment of the target nucleic acid. 140. The method of any one of embodiments 129-139, wherein the sample comprises at least one nucleic acid comprising at least 99% sequence identity to the segment of the target nucleic acid. 141. The method of any one of embodiments 129-140, wherein the sample comprises at least one nucleic acid comprising less than 100% sequence identity to the segment of the target nucleic acid and no less than 50% sequence identity to the segment of the target nucleic acid. 142. The method of any one of embodiments 129-141, wherein the sample comprises at least one nucleic acid comprising less than 100% sequence identity to the segment of the target nucleic acid and no less than 80% sequence identity to the segment of the target nucleic acid. 143. The method of any one of embodiments 129-142, wherein the sample comprises at least one nucleic acid comprising less than 100% sequence identity to the segment of the target nucleic acid and no less than 90% sequence identity to the segment of the target nucleic acid. 144. The method of any one of embodiments 129-143, wherein the target nucleic acid comprises a single nucleotide mutation. 145. The method of any one of embodiments 129-144, wherein the segment of the target nucleic acid comprises a single nucleotide mutation. 146. The method of any one of embodiments 129-145, wherein the single nucleotide mutation is a synonymous substitution or a nonsynonymous substitution. 147. The method of any one of embodiments 129-146, wherein the synonymous substitution is a silent substitution. 148. The method of any one of embodiments 129-147, wherein the nonsynonymous substitution is a missense substitution or a nonsense point mutation. 149. The method of any one of embodiments 129-148, wherein the target nucleic acid comprises a deletion. 150. The method of any one of embodiments 129-149, wherein the segment of the target nucleic acid comprises a deletion. 151. The method of any one of embodiments 129-150, wherein the deletion comprises a deletion of from 1 to 50 nucleotides. 152. The method of any one of embodiments 129-151, wherein the deletion comprises a deletion of from 9 to 21 nucleotides. 153. The method of any one of embodiments 129-152, further comprising amplifying the target nucleic acid segment using a primer having a region that is reverse complementary to the target nucleic acid segment and a region that has a PAM sequence reverse complement, thereby generating a PAM target nucleic acid having a PAM sequence adjacent to target sequence of an amplification product before the contacting. 154. The method of any one of embodiments 129-153, wherein the primer is a forward primer comprising the sequence encoding the PAM and has 1-8 nucleotides from the 3' end of the sequence encoding the PAM. 155. The method of any one of embodiments 129-154, wherein the primer is a forward primer comprising the sequence encoding the PAM and has 4 nucleotides from the 3' end of the sequence encoding the PAM. 156. The method of any one of embodiments 129-155, wherein the primer is a forward primer comprising the sequence encoding the PAM and has 5 nucleotides from the 3' end of the sequence encoding the PAM. 157. The method of any one of embodiments 129-156, wherein the primer is a forward primer comprising the sequence encoding the PAM and has 6 nucleotides from the 3' end of the sequence encoding the PAM. 158. The method of any one of embodiments 129-157, wherein the segment of the target nucleic acid comprises the single nucleotide mutation at 5-9 nucleotides downstream of the 5' end the segment of the target nucleic acid comprising the sequence the encoding the PAM. 159. The method of any one of embodiments 129-158, wherein the segment of the target nucleic acid comprises the single nucleotide mutation at 6 nucleotides downstream of the 5' end the segment of the target nucleic acid comprising the sequence the encoding the PAM. 160. The method of any one of embodiments 129-159, wherein the segment of the target nucleic acid comprises the single nucleotide mutation at 7 nucleotides downstream of the 5' end the segment of the target nucleic acid comprising the sequence the encoding the PAM. 161. The method of any one of embodiments 129-160, wherein the segment of the target nucleic acid comprises the single nucleotide mutation at 8 nucleotides downstream of the 5' end the segment of the target nucleic acid comprising the sequence the encoding the PAM. 162. The method of any one of embodiments 129-161, wherein the segment of the target nucleic acid comprises the deletion at 5-9 nucleotides downstream of the 5' end the segment of the target nucleic acid comprising the sequence the encoding the PAM. 163. The method of any one of embodiments 129-162, wherein the segment of the target nucleic acid comprises the deletion at 6 nucleotides downstream of the 5' end the segment of the target nucleic acid comprising the sequence the encoding the PAM. 164. The method of any one of embodiments 129-163, wherein the segment of the target nucleic acid comprises the deletion at 7 nucleotides downstream of the 5' end the segment of the target nucleic acid comprising the sequence the encoding the PAM. 165. The method of any one of embodiments 129-164, wherein the segment of the target nucleic acid comprises the deletion at 8 nucleotides downstream of the 5' end the segment of the target nucleic acid comprising the sequence the encoding the PAM. 166. The method of any one of embodiments 129-165, further comprising amplifying the target nucleic acid before the contacting. 167. The method of any one of embodiments 129-166, wherein the amplifying the target nucleic acid before the contacting comprises using a blocking primer. 168. The method of any one of embodiments 129-167, wherein the blocking primer binds to a nucleic acid comprising encoding the wild type sequence of the target nucleic acid segment. 169. The method of any one of embodiments 129-168, wherein the amplifying comprises COLD-PCR. 170. The method of any one of embodiments 129-169, wherein the COLD-PCR comprises full COLD-PCR. 171. The method of any one of embodiments 129-170, wherein the COLD-PCR comprises fast COLD-PCR. 172. The method of any one of embodiments 129-171, wherein the amplifying comprises fast COLD-PCR. 173. The method of any one of embodiments 129-172, wherein the amplifying comprises allele-specific PCR. 174. The method of any one of embodiments 129-173, wherein the amplifying further comprises COLD-PCR. 175. The method of any one of embodiments 129-174, further comprising removing a nucleic acid comprising at least 50% sequence identity to the target nucleic acid by binding a protein to the nucleic acid before the contacting. 176. The method of any one of embodiments 129-175, wherein the protein is an antibody. 177. The method of any one of embodiments 129-176, wherein the protein is a programmable nuclease without endonuclease activity. 178. The method of any one of embodiments 129-177, further comprising binding a protein to the target nucleic acid to remove other nucleic acids of the sample. 179. The method of any one of embodiments 129-178, wherein the other nucleic acids comprise a nucleic acid comprising at least 50% sequence identity to the target nucleic acid. 180. The method of any one of embodiments 129-179, wherein the protein is attached to a surface. 181. The method of any one of embodiments 129-180, wherein the removing of the other nucleic acids comprises washing away nucleic acids that are not bound to the protein. 182. The method of any one of embodiments 129-181, wherein the protein is an antibody. 183. The method of any one of embodiments 129-182, wherein the protein is a programmable nuclease without endonuclease activity. 184. The method of any one of embodiments 129-183, wherein the programmable nuclease is a target nucleic acid activated effector protein that exhibits sequence independent cleavage upon activation. 185. The method of any one of embodiments 129-184, wherein the programmable nuclease is an RNA guided nuclease. 186. The method of any one of embodiments 129-185, wherein the programmable nuclease comprises a Cas nuclease. 187. The method of any one of embodiments 129-186, wherein the Cas nuclease is Cas13. 188. The method of any one of embodiments 129-187, wherein the Cas13 is Cas13a, Cas13b, Cas13c, Cas13d, or Cas13e. 189. The method of any one of embodiments 129-188, wherein the Cas nuclease is Cas12. 190. The method of any one of embodiments 129-189, wherein the Cas12 is Cas12a, Cas12b, Cas12c, Cas12d, or Cas12e. 191.

The method of any one of embodiments 129-190, wherein the Cas nuclease is Cas14. 192. The method of any one of embodiments 129-191, wherein the Cas14 is Cas14a, Cas14b, Cas14c, Cas14d, Cas14e, Cas14f, Cas14g, or Cas14h. 193. The method of any one of embodiments 129-192, wherein the Cas nuclease is Csm1, Cas9, C2c4, C2c8, C2c5, C2c10, or C2c9. 194. The method of any one of embodiments 129-193, wherein the guide nucleic acid comprises a crRNA. 195. The method of any one of embodiments 129-194, wherein the guide nucleic acid comprises a crRNA and a tracrRNA. 196. The method of any one of embodiments 129-195, wherein cleavage of at least one detector nucleic acid yields a signal. 197. The method of any one of embodiments 129-196, wherein cleavage of at least one detector nucleic acid activates a photoexcitable fluorophore. 198. The method of any one of embodiments 129-197, wherein cleavage of at least one detector nucleic acid deactivates a photoexcitable fluorophore. 199. The method of any one of embodiments 129-198, wherein the signal is present prior to detector nucleic acid cleavage. 200. The method of any one of embodiments 129-199, wherein the signal is absent prior to detector nucleic acid cleavage. 201. The method of any one of embodiments 129-200, wherein the sample comprises blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. 202. The method of any one of embodiments 129-201, wherein the single nucleotide mutation is a single nucleotide polymorphism. 203. A method, comprising: contacting a programmable nuclease comprising a polypeptide having endonuclease activity and a guide nucleic acid to a target nucleic acid in a buffer comprising heparin. 204. The method of any one of embodiments 129-203, wherein the heparin is present at a concentration of from 1 to 100 µg/ml heparin. 205. The method of any one of embodiments 129-204, wherein the heparin is present at a concentration of from 40 to 60 µg/ml heparin. 206. The method of any one of embodiments 129-205, wherein the heparin is present at a concentration 50 µg/ml heparin. 207. The method of any one of embodiments 129-206, wherein the buffer further comprises NaCl. 208. The method of any one of embodiments 129-207, wherein the NaCl is present at a concentration of from 1 to 200 mM NaCl. 209. The method of any one of embodiments 129-208, wherein the NaCl is present at a concentration of from 80 to 120 mM NaCl. 210. The method of any one of embodiments 129-209, wherein the NaCl is present at a concentration of 100 mM NaCl. 211. The method of any one of any one of embodiments 129-210, wherein the target nucleic acid is a substrate target nucleic acid. 212. The method of any one of embodiments 129-211, wherein the substrate nucleic acid comprises a cancer allele. 213. The method of any one of embodiments 129-212, wherein the cancer allele is present at a low concentration relative to a wild type allele. 214. The method of any one of embodiments 129-213, wherein the substrate target nucleic acid comprises a splice variant. 215. The method of any one of embodiments 129-214, wherein the substrate target nucleic acid comprises an edited base. 216. The method of any one of embodiments 129-215, wherein the substrate target nucleic acid comprises a bisulfite-treated base. 217. The method of any one of embodiments 129-216, wherein the substrate target nucleic acid comprises a segment that is reverse complementary to a segment of the guide nucleic acid. 218. A method of designing a plurality of primers for amplification of a target nucleic acid, the method comprising: providing a target nucleic acid, wherein a guide nucleic acid hybridizes to the target nucleic acid and wherein at least 60% of a sequence of the target nucleic acid is between an F1c region and a B1 region or between an F1 and a B1c region; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region. 219. A method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the guide nucleic acid hybridizes to the target nucleic acid and wherein at least 60% of a sequence of the target nucleic acid is between the F1c region and a B1 region or between an F1 region and the B1c region; a reporter; and a programmable nuclease that cleaves the reporter when complexed with the guide nucleic acid upon hybridization of the guide nucleic acid to the target nucleic acid; and measuring a detectable signal produced by cleavage of the reporter, wherein the measuring provides for detection of the target nucleic acid in the sample. 220. The method of any one of embodiments 129-219, wherein the sequence between the F1c region and the B1 region or the sequence between the B1c region and the F1 region is at least 50% reverse complementary to the guide nucleic acid sequence. 221. The method of any one of embodiments 129-220, wherein the guide nucleic acid sequence is reverse complementary to no more than 50% of the forward inner primer, the backward inner primer, or a combination thereof 222. The method of any one of embodiments 129-221, wherein the guide nucleic acid does not hybridize to the forward inner primer and the backward inner primer. 223. The method of any one of embodiments 129-222, wherein a protospacer adjacent motif (PAM) or a protospacer flanking site (PFS) is 3' of the target nucleic acid. 224. The method of any one of embodiments 129-223, wherein a protospacer adjacent motif (PAM) or a protospacer flanking site (PFS) is 3' of the B1 region and 5' of the F1c region or the protospacer adjacent motif (PAM) or a protospacer flanking site (PFS) is 3' of the F1 region and 5' of the B1c region. 225. The method of any one of embodiments 129-224, wherein the 3' end of the target nucleic acid is 5' of the 5' end of the F3c region or the 3' end of the target nucleic acid is 5' of the 5' end of the B3c region. 226. The method of any one of embodiments 129-225, wherein the 3' end of the target nucleic acid is 5' of the 5' end of the F2c region or 3' end of the target nucleic acid is 5' of the 5' end of the B2c region. 227. The method of any one of embodiments 129-226, wherein the target nucleic acid is between the F1c region and the B1 region and the 3' end of the target nucleic acid is 5' of the 3' end of the F2c region, or wherein the target nucleic acid is between the B1c region and the F1 region and the 3' end of the target nucleic acid is 5' of the 3' end of the B2c region. 228. The method of any one of embodiments 129-227, wherein the guide nucleic acid has a sequence reverse complementary to no more than 50% of the forward inner primer, the backward inner primer, the forward outer primer, the backward outer primer, or any combination thereof 229. The method of any one of embodiments 129-228, wherein the guide nucleic acid sequence does not hybridize to the forward inner primer, the backward inner primer, the forward outer primer, the backward outer primer, or any combination thereof 230. The method of any one of embodiments 129-229, wherein the guide nucleic acid sequence has a sequence reverse complementary to no more than 50% of a sequence of an F3c region, an F2c region, the F1c region, the B1c region, an B2c region, an B3c region, or any combination thereof 231. The method of any one of embodiments 129-230, wherein the guide nucleic acid sequence does not hybridize to a sequence of an F3c region, an F2c region, the F1c region, the B1c region, an B2c region, an B3c region, or any combination thereof 232. A method of designing a plurality of primer for amplification of a target nucleic acid, the method comprising: providing the target nucleic acid comprising a sequence between a B2 region and a B1 region or between an F2 region and an F1 region that hybridizes to a guide nucleic acid; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region. 233. A method of designing a plurality of primer for amplification of a target nucleic acid, the method comprising: providing the target nucleic acid comprising a sequence between a F1c region and an F2c region or between a B1c region and a B2c region that hybridizes to a guide nucleic acid; and designing the plurality of primers comprising: i) a forward inner primer comprising a sequence of the F1c region 5' of a sequence of an F2 region; ii) a backward inner primer comprising a sequence of the B1c region 5' of a sequence of a B2 region; iii) a forward outer primer comprising a sequence of an F3 region; and iv) a backward outer primer comprising a sequence of a B3 region. 234. A method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the target nucleic acid comprises a sequence between a B2 region and a B1 region or between the F2 region and an F1 region that hybridizes to the guide nucleic acid; a reporter; and a programmable nuclease that cleaves the reporter when complexed with the guide nucleic acid upon hybridization of the guide nucleic acid to the target nucleic acid; and measuring a detectable signal produced by cleavage of the reporter, wherein the measuring provides for detection of the target nucleic acid in the sample. 235. A method of detecting a target nucleic acid in a sample, the method comprising: contacting the sample to: a plurality of primers comprising: i) a forward inner primer comprising a sequence corresponding to an F1c region 5' of a sequence corresponding to an F2 region; ii) a backward inner primer comprising a sequence corresponding to a B1c region 5' of a sequence corresponding to a B2 region; iii) a forward outer primer comprising a sequence corresponding to an F3 region; and iv) a backward outer primer comprising a sequence corresponding to a B3 region; a guide nucleic acid, wherein the target nucleic acid comprises a sequence between the F1c region and an F2c region or between the B1c region and a B2c region that hybridizes to the guide nucleic acid; a reporter; and a programmable nuclease that cleaves the reporter when complexed with the guide nucleic acid upon hybridization of the guide nucleic acid to the target nucleic acid; and measuring a detectable signal produced by cleavage of the reporter, wherein the measuring provides for detection of the target nucleic acid in the sample. 236. The method of any one of embodiments 129-235, wherein a protospacer adjacent motif (PAM) or a protospacer flanking site (PFS) is 3' of the B2 region and 5' of the B1 region or the protospacer adjacent motif (PAM) or a protospacer flanking site (PFS) is 3' of the F2 region and 5' of the F1 region. 237. The method of any one of embodiments 129-236, wherein a protospacer adjacent motif (PAM) or a protospacer flanking site (PFS) is 3' of the B1c region and 5' of the B2c region or the protospacer adjacent motif (PAM) or a protospacer flanking site (PFS) is 3' of the F1c region and 5' of the F2c region. 238. The method of any one of embodiments 129-237, wherein a protospacer adjacent motif (PAM) or a protospacer flanking site (PFS) is 3' of the target nucleic acid. 239. The method of any one of embodiments 129-238, wherein the PAM and the PFS are 5' of the 5' end of the F1c region, 5' of the 5' end of the B1c region, 3' of the 3' end of the F3 region, 3' of the 3' end of the B3 region, 3' of the 3' end of the F2 region, 3' of the 3' end of the B2 region, or any combination thereof 240. The method of any one of embodiments 129-239, wherein the PAM and the PFS do not overlap the F2 region, the B3 region, the F1c region, the F2 region, the B1c region, the B2 region, or any combination thereof 241. The method of any one of embodiments 129-240, wherein the PAM and the PFS do not hybridize to the forward inner primer, the backward inner primer, the forward outer primer, the backward outer primer, or any combination thereof 242. The method of any one of embodiments 129-241, wherein the plurality of primers further comprises a loop forward primer. 243. The method of any one of embodiments 129-242, wherein the plurality of primers further comprises a loop backward primer. 244. The method of any one of embodiments 129-243, wherein the loop forward primer is between an F1c region and an F2c region. 245. The method of any one of embodiments 129-244, wherein the loop backward primer is between a B1c region and a B2c region. 246. The method of any one of embodiments 129-245, wherein the target nucleic acid comprises a single nucleotide polymorphism (SNP). 247. The method of any one of embodiments 129-246, wherein the single nucleotide polymorphism (SNP) comprises a HERC2 SNP. 248. The method of any one of embodiments 129-247, wherein the single nucleotide polymorphism (SNP) is associated with an increased risk or decreased risk of cancer. 249. The method of any one of embodiments 129-248, wherein the target nucleic acid comprises a single nucleotide polymorphism (SNP), and wherein the detectable signal is higher in the presence of a guide nucleic acid that is 100% complementary to the target nucleic acid comprising the single nucleotide polymorphism (SNP) than in the presence of a guide nucleic acid that is less than 100% complementary to the target nucleic acid comprising the single nucleotide polymorphism (SNP). 250. The method of any one of embodiments 129-249, wherein the plurality of primers and the guide nucleic acid are present together in a sample comprising the target nucleic acid. 251. The method of any one of embodiments 129-250, wherein the amplifying and the contacting the sample to the guide nucleic acid occurs at the same time. 252. The method of any one of embodiments 129-251, wherein the amplifying and the contacting the sample to the guide nucleic acid occur at different times. 253. The method of any one of embodiments 129-252, wherein the method further comprises providing a polymerase, a dATP, a dTTP, a dGTP, a dCTP, or any combination thereof 254. A method of assaying for a target nucleic acid segment in a sample, wherein the target nucleic acid segment lacks a PAM sequence, comprising: amplifying the target nucleic acid segment using a primer having a region that is reverse complementary to the target nucleic acid segment and a region that has a PAM sequence reverse complement, thereby generating a PAM target nucleic acid having a PAM sequence adjacent to a target sequence of an amplification product; contacting the PAM target nucleic acid to a PAM-dependent sequence specific nuclease complex comprising a guide nucleic acid and a programmable nuclease that exhibits sequence independent cleavage upon forming a complex comprising the segment of the guide nucleic acid binding to the segment of the PAM target nucleic acid; and assaying for cleavage of at least one detector nucleic acid of a population of detector nucleic acids, wherein the cleavage indicates a presence of the target nucleic acid in the sample and wherein the absence of the cleavage indicates an absence of the target nucleic acid in the sample. 255. The method of embodiment 254, wherein the sequence encoding the PAM comprises dUdUdUN. 256. The method any one of embodiments 254-255, wherein the primer is a forward primer comprising the sequence encoding the PAM and has 3 nucleotides from the 3' end of the sequence encoding the PAM. 257. The method any one of embodiments 254-256, wherein the primer is a forward primer comprising the sequence encoding the PAM and has 1-2 or 4-8 nucleotides from the 3' end of the sequence encoding the PAM. 258. The method of any one of embodiments 254-257, wherein the primer is a forward primer comprising the sequence encoding the PAM and has 2 nucleotides from the 3' end of the sequence encoding the PAM. 259. The method of any one of embodiments 254-258, wherein the primer is a forward primer comprising the sequence encoding the PAM and has 4 nucleotides from the 3' end of the sequence encoding the PAM. 260. The method of any one of embodiments 254-259, wherein the primer is a forward primer comprising the sequence encoding the PAM and has 5 nucleotides from the 3' end of the sequence encoding the PAM. 261. The method of any one of embodiments 254-260, wherein the primer is a forward primer comprising the sequence encoding the PAM and has 6 nucleotides from the 3' end of the sequence encoding the PAM. 262. The method of any one of embodiments 254-261, wherein a mismatch for single nucleotide polymorphism (SNP) detection is 3-10 nucleotides downstream of the PAM in PAM target nucleic acid. 263. The method of any one of embodiments 254-262, wherein a mismatch for single nucleotide polymorphism (SNP) detection is 6 nucleotides downstream of the PAM in PAM target nucleic acid. 264. The method of any one of embodiments 254-263, wherein a mismatch for single nucleotide polymorphism (SNP) detection is 7 nucleotides downstream of the PAM in PAM target nucleic acid. 265. The method of any one of embodiments 254-264, wherein a mismatch for single nucleotide polymorphism (SNP) detection is 8 nucleotides downstream of the PAM in PAM target nucleic acid. 266. The method of any one of embodiments 254-265, wherein the amplifying comprises thermal cycling amplification. 267. The method of any one of embodiments 254-266, wherein the amplifying comprises isothermal amplification. 268. The method of any one of embodiments 254-267, wherein the isothermal amplification is select from the group consisting of isothermal recombinase polymerase amplification (RPA), transcription mediated amplification (TMA), strand displacement amplification (SDA), helicase dependent amplification (HDA), loop mediated amplification (LAMP), rolling circle amplification (RCA), single primer isothermal amplification (SPIA), ligase chain reaction (LCR), simple method amplifying RNA targets (SMART), improved multiple displacement amplification (IMDA), and nucleic acid sequence-based amplification (NASBA). 269. The method of any one of embodiments 254-268, wherein the producing, the contacting, and the assaying are performed in a common reaction volume. 270. The method of any one of embodiments 254-269, wherein the programmable nuclease is a nucleic acid activated effector protein that exhibits sequence independent cleavage upon activation. 271. The method of any one of embodiments 254-270, wherein the programmable nuclease is an RNA guided nuclease. 272. The method of any one of embodiments 254-271, wherein the programmable nuclease comprises a Cas nuclease. 273. The method of any one of embodiments 254-272, wherein the Cas nuclease is Cas12. 274. The method of any one of embodiments 254-273, wherein the Cas12 is Cas12a, Cas12b, Cas12c, Cas12d, or Cas12e. 275. The method of any one of embodiments 254-274, wherein the cas nuclease is Cas13. 276. The method of any one of embodiments 254-275, wherein the cas nuclease is Cas13a, Cas13b, Cas13c, or Cas13d. 277. The method of any one of embodiments 254-276, wherein the guide nucleic acid comprises a crRNA. 278. The method of any one of embodiments 254-277, wherein cleavage of at least one detector nucleic acid yields a signal. 279. The method of any one of embodiments 254-278, wherein cleavage of at least one detector nucleic acid activates a photoexcitable fluorophore. 280. The method of any one of embodiments 254-279, wherein cleavage of at least one detector nucleic acid deactivates a photoexcitable fluorophore. 281. The method of any one of embodiments 254-280, wherein the signal is present prior to detector nucleic acid cleavage. 282. The method of any one of embodiments 254-281, wherein the signal is absent prior to detector nucleic acid cleavage. 283. The method of any one of embodiments 254-282, wherein the at least one detector nucleic acid comprises a nucleic acid comprising a detectable moiety. 284. The method of any one of embodiments 254-283, wherein the at least one detector nucleic acid comprises a nucleic acid comprising at least two nucleotides, a fluorophore, and a fluorescence quencher, wherein the fluorophore and the fluorescence quencher are linked by the nucleic acid. 285. The method of any one of embodiments 254-284, wherein the sample comprises blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. 286. The method of any one of embodiments 254-285, wherein the target nucleic acid comprises a sequence encoding a single nucleotide polymorphism (SNP). 287. The method of any one of embodiments 254-286, wherein the target nucleic acid comprises a sequence encoding a wild type sequence. 288. The method of any one of embodiments 254-287, wherein the SNP is in the EGFR gene. 289. The method of any one of embodiments 254-288, wherein the SNP is associated with a disease. 290. The method of any one of embodiments 254-289, wherein the SNP is a HERC2 SNP, an ALDH2 SNP, an EGFR SNP, a PNPLA3 SNP, a CYP2C19*2 SNP, a PAH SNP, a CFTR SNP, a β-globin SNP, a DMD SNP, a APOB SNP, a LDLR SNP, a LDLRAP1 SNP, a PCSK9 SNP, a NF1 SNP, a PKD1 SNP, a DMPK SNP, a F9 SNP, a F8 SNP, a PKD1 SNP, a PHEX SNP, or a MECP SNP. 291. The method of any one of embodiments 254-290, wherein the disease is cancer. 292. The method of any one of embodiments 254-291, wherein the disease is a genetic disorder. 293. The method of any one of embodiments 254-292, wherein the SNP is associated with altered phenotype compared to a wild type sequence.

EXAMPLES

The following examples are illustrative and non-limiting to the scope of the devices, systems, fluidic devices, kits, and methods described herein.

Example 1

Substrate Screen (Trans Cleavage)

Trans cleavage assays were performed activity buffer (buffer: 120 mM NaCl, 5 mM $MgCl_2$, 20 mM Tris pH 7.5, 1% glycerol). A final concentration of 100 nM and 50 nM of different target dsDNA (varying in PAM and mismatches) and ssDNA-FQ reporter molecule were used in the assay respectively. Target dsDNA was obtained by annealing complementary ssDNA primers with 2:1 ratio of non-target strand to target strand in hybridization buffer (10× Hybridization buffer: 500 mM NaCl, 10 mM Tris pH 8.0, 1 mM EDTA) This ensures double-stranded DNA is being detected instead of single-stranded DNA.

crRNA was synthesized via in-vitro transcription using T7 RNA polymerase and a DNA template that consists of T7 binding site sequence followed by repeat region and targets sequence. Synthesized crRNA was then purified via bead purification and quantified using Quant-It miRNA kit.

To prepare the assay, a mastermix that consists of nuclease free water, ssDNA-FQ reporter, and 5× activity buffer was made and distributed to 12 different 1.5 mL microcentrifuge tubes. Each tube is for each protein ortholog. Add the protein of interest and the guide RNA to each tube and proceed to incubation for 20 minutes at 37 C. Transfer 16 uL of each of the incubated mastermix per reaction.

To activate the assay, add 4 uL of 500 nM target dsDNA into the reaction. Place the plate to a fluorescence reader for 2 hours.

Example 2

Cis (Target) Cleavage Assays

Cis (target) cleavage assays were performed at 25° C. or 37° C. in activity buffer (120 mM NaCl, 5 mM $MgCl_2$, 20 mM Tris pH 7.5, 1% glycerol). Cas12a-crRNA complex formation was performed in activity buffer, generally at a molar ratio of 1:1.25 protein to crRNA at 37° C. for 10 min, a target dsDNA. The target for cis-cleavage is a PCR product that is 1200 bp long and contains the target sequence at the 700th position. A restriction site for BamHI was also introduced around the vicinity of the target sequence. Unless otherwise indicated, final concentrations of protein, guide and targets were 100 nM, 125 nM and 15 nM, respectively, for all reactions. Reactions were quenched with 6× loading dye and resolved by prestained 2% agarose gel (1×TAE buffer). The cis cleavage reaction has the same conditions as the trans cleavage reaction but without a reporter molecule and a target dsDNA final concentration of 15 nM.

Example 3

Limit of Detection Assays

To monitor the limit of detection (LOD) of each chosen protein ortholog, DETECTR assay was used. The reaction cocktail is identical to that of the substrate screen assay. The only difference is the target concentration; target concentrations of 100 nM, 10 nM, 1 nM, 100 pM, 10 pM, 1 pM, 100 fM, 10 fM, and 1 fM were prepared via rehybridization as mentioned above and serial dilution.

Example 4

Guide Processing Assays

Pre-crRNA cleavage assays are performed at 37° C. in Activity Buffer based on previous buffer optimization experiments 100-fold molar excess of Cpf1 relative to synthesized crRNA (final concentrations of 100 nM and <1 nM, respectively). Unless otherwise indicated, the reaction is quenched after 1h with 2×RNA loading dye (100% formamide, 0.025% (w/v) bromophenol blue and 200 µg/mL heparin). After quenching, reactions are denatured at 95° C. for 2 min before resolving by 15% denaturing PAGE (1×TBE buffer).

Example 5

Temperature Assays

Each protein is pre-complexed by adding its crRNA and preincubated at 25 C for 1 hour. After the 1 hour period, each protein complex is incubated in different temperatures for 10 minutes. The temperatures are: 4, 22, 37, and 48. After incubation, the protein complex is tested via DETECTR.

Example 6

Nickase Assays

A pUC19 is treated with a Cas14 comprising a guide nucleic comprising a segment of nucleic acid that is reverse complementary with a segment of pUC19. After treatment, a band is produced when run on a gel that is higher than the linearized pUC19 fragment produced by digestion with EcoR1. A band that is higher than the linearized pUC19 is produced when no tracr nucleic acid is added to the treatment, and a band that is higher than the linearized pUC19 is produced when either a tracr nucleic acid comprising or lacking a PAM sequence is added to the treatment. This indicates that the Cas14 is a nickase and is PAM independent and tracr nucleic acid independent. However, a lower band than the linearized pUC19 is produced when no guide nucleic acid is added, indicating that the cleavage is guide nucleic acid directed.

Example 7

Optimization of Temperature and Temperature Tolerance of CRISPR-Cas Proteins in CRISPR Diagnostics This example describes optimization of temperature and temperature tolerance of CRISPR-Cas proteins in CRISPR diagnostics. The CRISPR diagnostics of the present disclosure leverage the unique biochemical properties of Type V (e.g., Cas12) and Type VI (e.g., Cas13) CRISPR-Cas proteins to enable the specific detection of nucleic acids. These proteins are directed to their target nucleic acid by a CRISPR RNA (crRNA), which is also known as a guide RNA (gRNA). Once bound to a complementary target sequence, the Cas protein initiates indiscriminate cleavage of surrounding single-strand DNA or single-strand RNA. When coupled to a quenched fluorescence reporter or other cleavage reporter, fluorescent or other signal can be generated by the Cas protein only in the presence of the target nucleic acid. CRISPR-Cas proteins have been isolated from a variety of natural contexts and therefore have different tolerances for elevated temperatures and optimal temperature ranges. These different tolerances for temperature can be used to activate or inhibit the proteins at different stages to allow for other molecular processes, such as target amplification, to occur.

A Cas12 variant (SEQ ID NO: 11), LbCas12a (SEQ ID NO: 1), and LbuCas13a (SEQ ID NO: 104) were incubated at 25° C., 30° C., 35° C., 40° C., 45° C., and 50° C. with a target nucleic acid sequence. Detection assays using the various Cas proteins were set up using 1 nM DNA target for Cas12 proteins and 25 pM RNA target for Cas13a. The max_rate (fluriescence units/2 min) was determined for evaluating the efficiency of the proteins at various temperatures. Darker squares indicate a higher max_rate and more efficient activity.

FIG. 18 shows activity of three programmable nucleases, a Cas12 variant (SEQ ID NO: 11), LbCas12a (SEQ ID NO: 1), and LbuCas13a (SEQ ID NO: 104, also referred to herein as Lbu C2C2). The results show that the functional range for the Cas12 variant (SEQ ID NO: 11) is between 25° C. and 45° C., with maximal activity at 35° C. For the Type V Cas12 protein LbCas12a (SEQ ID NO: 1) the functional range is from 35° C. to 50° C. with peak activity around 40° C. For the Type VI protein LbuCas13a (SEQ ID NO: 104) the functional range is between 25° C. and 40° C. with maximal activity between 30° C. and 35° C. As suggested in FIG. 18, it appears that Type V proteins, such as the Cas12 variant (SEQ ID NO: 11) and LbCas12a (SEQ ID NO: 1), may be stable and functional at elevated temperatures. To test how stable each of these proteins are, proteins were incubated for 15 minutes at 45° C., 50° C., 55° C., 60° C., 65° C., or 70° C. and then decreased the reaction temperature to 37° C.

FIG. 19 shows the results of incubating two Cas12 proteins, SEQ ID NO: 1 and SEQ ID NO: 11, for 15 minutes at 45° C., 50° C., 55° C., 60° C., 65° C., or 70° C. and then decreasing the reaction temperature to 37° C. LbCas12a (SEQ ID NO: 1) was found to be functional even after incubation at 65° C. The Cas12 variant (SEQ ID NO: 11) was found to have no activity while at temperatures above 50° C., but after lowering the temperature to 37° C., the enzymatic activity of the protein returned. This temperature shifting may be exploitable for use in isothermal amplification methods, where the amplification occurs at a higher temperature, but after lowering the reaction temperature the Cas protein can be activated without compromising its functionality.

FIG. 20 shows that the stability of the Cas12 variant (SEQ ID NO: 11) at elevated temperatures is dependent on the buffer composition. Stability of the Cas12 variant was assessed after exposure to elevated temperatures for 30 minutes and then lowering the reaction temperature to 37° C. A variety of buffers were tested to determine their impact on the ability to turn the Cas12 variant on and off based on the reaction temperature. 0.5×NEBuffer4 (New England Biolabs, 1×: 50 mM Potassium Acetate; 20 mM Tris-acetate, pH 7.9; 10 mM Magnesium Acetate; 1 mM DTT)+0.05% Tween gave the best results, followed by 1× MBuffer3 (20 mM HEPES pH 7.5; 2 mM Potassium Acetate; 5 mM Mg Acetate; 1% glycerol; 0.00016% Triton-X). 0.5× of Isothermal Amplification (IsoAmp) buffer (New England Biolabs) inhibited the Cas12 variant reaction completely.

Example 8

Optimization of Assay Conditions for CRISPR DETECTR-Based Diagnostic Assays

This example describes optimization of assay conditions for the CRISPR-Cas DETECTR-based diagnostic assays disclosed herein. The components of the DETECTR reaction, such as protein concentration, crRNA, and buffer components impact the rate and efficiency of the reaction. Optimization of the buffers allows for the development of an assay with increased sensitivity and specificity.

Improvements to buffers and assay conditions were identified for LbuCas13a (SEQ ID NO: 104) included 100 ng/µL of tRNA. The performance of a HEPES pH 6.8 buffer for Cas13a detection (20 mM HEPES pH 6.8; 50 mM KCl; 5 mM MgCl$_2$; 10 µg/mL BSA; 100 µg/4 tRNA; 0.01% Igepal Ca-630 (NP-40); 5% Glycerol) is shown on the graph is the middle-most line. Cas13a was incubated with 1 pM of target RNA at 37 C with varying concentrations of tRNA in the reaction buffer. As a control, the assay was also performed with 0 pM of the target RNA. FIG. 21 shows graphs of activity of a Cas13 (SEQ ID NO: 104), as measured by fluorescence, with (left graph) and without (right graph) activator over time. FIG. 21 shows that increasing the amount of tRNA in the reaction decreases the efficiency of the Cas13a detection assay. Similarly, decreasing the amount of tRNA in the reaction or eliminating it completely, increases the efficiency of the Cas13a detection assay without dramatically changing the stability of the reaction in the absence of activator.

Urea is an additive that is used to increase the efficiency of some enzymatic reactions, such as proteinase K digestion, and is present in urine. To evaluate inhibition of Cas13a activity in the DETECTR assays, 1 pM of target RNA at 37° C. was incubated with varying concentrations of urea. The activator, shown in the following graphs, is the target RNA. FIG. 22 shows inhibition of Cas13a (SEQ ID NO: 104) activity by SDS and urea. FIG. 22A shows the Cas13a (SEQ ID NO: 104) detection assay performed in the presence of 0-200 mM urea. Concentrations above 300 mM urea inhibited the assay (left graph shows with activator and right graph shows without activator). The orange line indicates the performance of the assay with 0 mM urea (a control showing uninhibited Cas13a activity). SDS is a common inhibitor of RNases and is used to eliminate RNase contamination and denature proteins. To evaluate inhibition of Cas13a activity in DETECTR assays, 1 pM target RNA at 37° C. was incubated with varying amounts of SDS. FIG. 22B shows complete inhibition of Cas13a (SEQ ID NO: 104) upon addition of 0.1% or greater amounts of SDS to the reaction (left graph shows with activator and right graph shows without activator). The orange line indicates performance of Cas13a with 0% SDS (a control showing uninhibited Cas13a activity).

The importance of salt type and salt concentration on the performance of Cas13a in a DETECTR assay was evaluated. DETECTR assays were performed with 10 pM of target or 0 pM of target (control). FIG. 23 shows the performance of Cas13a (SEQ ID NO: 104) in DETECTR reactions with varying concentrations of salt. FIG. 23A shows the results of varying the concentration of NaCl in a Cas13a (SEQ ID NO: 104) DETECTR reaction. FIG. 23B shows the results of varying the concentration of KCl in a Cas13a (SEQ ID NO: 104) DETECTR reaction. Cas13a performed comparably between NaCl and KCl salt types. Cas13a performance decreased at 30 mM salt and below, and was inhibited by salt concentrations above 80 mM.

The importance of DTT in different salt types and its impact on Cas13a (SEQ ID NO: 104) performance in a DETECTR assay was evaluated. DTT was used to stabilize proteins, such as RNase inhibitors, and increase the efficiency of some enzymes. DETECTR assays were carried out using Cas13a for detection of 10 pM of target or no target (control). FIG. 24 shows optimization of DTT concentration in a Cas13a (SEQ ID NO: 104) DETECTR assay. FIG. 24A shows activity of a Cas13a (SEQ ID NO: 104) at varying DTT concentration in NaCl. FIG. 24B shows activity of a Cas13a (SEQ ID NO: 104) at varying DTT concentrations in KCl. The orange bar indicates buffer conditions with 50 mM KCl and no DTT. In addition to the indicated KCl and DTT concentration, each buffer condition also contained 20 mM HEPES pH 6.8, 5 mM $MgCl_2$, 10 µg/mL BSA, 100 µg/mL tRNA, 0.01% Igepal Ca-630 (NP-40), and 5% Glycerol). The results showed that the Cas13a DETECTR assay was not affected by DTT concentrations from 0-10 mM in buffers containing either NaCl or KCl.

Reporter choice for the Cas13a DETECTR assay was evaluated. The quenched fluorescent reporter generates the fluorescent signal that is used to monitor Cas13a detection performance in the DETECTR assays. A variety of different RNA reporter sequences was evaluated for their impact on assay performance. Cas13a detection assays were performed with either 1 pM target RNA or no target RNA at 37° C. Reactions were performed in either a HEPES pH 6.8 Cas13a reaction buffer (HEPES pH 6.8 buffer with tRNA: 20 mM HEPES pH 6.8; 50 mM KCl; 5 mM $MgCl_2$; 10 µg/mL BSA; 100 µg/mL tRNA; 0.01% Igepal Ca-630; 5% glycerol) or in an identical buffer that lacked background tRNA "RNAlessPB". FIG. 25 shows the activity of Cas13a (SEQ ID NO: 104) in the DETECTR assay, as measured by fluorescence, for each of the tested reporters. The "U5" reporter (/5-6FAM/rUrUrUrUrU/3IABkFQ/(SEQ ID NO: 111)) and the "UU" reporter (/56-FAM/TArUrUGC/3IABkFQ/) exhibited the best performance. A reporter with the same nucleotide sequence as the "U5" reporter but with a different fluorophore and quencher, "TYE665U5" (/5-TYE665/rUrUrU-rUrU/3IABkRQ/(SEQ ID NO: 111)) also performed well. Increasing the length of the reporter generated higher background in processing buffers that did not contain background RNA.

The optimal buffer composition and pH for Cas13a DETECTR assays was identified. To determine the ideal buffer and pH for the Cas13a detection assay, 84 different combinations of buffers and pH were tested. The final buffer concentration used in each assay was 20 mM. Aside from the buffer itself, the remaining assay components included 50 mM KCl, 5 mM $MgCl_2$, 10 µg/mL BSA, 100 µg/ML tRNA, 0.01% Igepal Ca-630, and 5% Glycerol. Cas13a DETECTR assays were performed with 1 pM target RNA or no target RNA as a control. The dotted line indicates performance of a HEPES pH 6.8 Cas13a reaction buffer (also referred to as "HEPES pH 6.8 buffer"; HEPES pH 6.8 buffer with tRNA: 20 mM HEPES pH 6.8; 50 mM KCl; 5 mM $MgCl_2$; 10 µg/mL BSA; 100 µg/mL tRNA; 0.01% Igepal Ca-630; 5% glycerol). Dots indicate replicates. FIG. 26 shows Cas13a activity in the DETECTR assay, as measured by fluorescence, for each of the tested conditions. These results demonstrated that the optimal pH is around 7.5 and that the imidazole, phosphate, tricine, and SPG buffers are all high performing buffers, in comparison to the HEPES pH 6.8 buffer (20 mM HEPES pH 6.8; 50 mM KCl; 5 mM $MgCl_2$; 10 µg/mL BSA; 100 µg/mL tRNA; 0.01% Igepal Ca-630 (NP-40); 5% Glycerol). Cas13a detection was inhibited at pH values below 6.5.

Cas13a activity in DETECTR assays was assessed in a variety of commercially available buffers. Cas13a detection assays were carried out with either 1 pM target RNA or no target RNA at 37° C. Reactions were performed either in the presence or absence of 100 ng/µL tRNA. Buffers used included NEB1 (NEBuffer1, New England Biolabs (NEB)), NEB2 (NEBuffer2, NEB), NEB3 (NEBuffer3, NEB), Cutsmart (NEB), RNPB (RNA polymerase buffer, NEB), and the HEPES pH 6.8 buffer (20 mM HEPES pH 6.8; 50 mM KCl; 5 mM $MgCl_2$; 10 µg/mL BSA; 100 µg/mL tRNA; 0.01% Igepal Ca-630 (NP-40); 5% Glycerol). These buffer compositions are as follows: NEBuffer 1.1 (1× Buffer Components, 10 mM Bis-Tris-Propane-HCl, 10 mM $MgCl_2$, 100 µg/ml BSA, pH 7.0@25° C.); NEBuffer 2.1 (1× Buffer Components, 50 mM NaCl, 10 mM Tris-HCl, 10 mM $MgCl_2$, 100 µg/ml BSA, pH 7.9@25° C.); NEBuffer 3.1 (1× Buffer Components, 100 mM NaCl, 50 mM Tris-HCl, 10 mM $MgCl_2$, 100 µg/ml BSA, pH 7.9@25° C.); CutSmart Buffer (1× Buffer Components, 50 mM Potassium Acetate, 20 mM Tris-acetate, 10 mM Magnesium Acetate, 100 µg/ml BSA, pH 7.9@25° C.); and 1×RNAPol Reaction Buffer (40 mM Tris-HCl, 6 mM $MgCl_2$, 1 mM DTT, 2 mM spermidine (pH 7.9 @ 25° C.)). The results demonstrated that Cas13a performance improved in NEBuffer2 and Cutsmart in comparison to the HEPES pH 6.8 buffer (20 mM HEPES pH 6.8; 50 mM KCl; 5 mM $MgCl_2$; 10 µg/mL BSA; 100 µg/mL tRNA; 0.01% Igepal Ca-630 (NP-40); 5% Glycerol). FIG. 27 shows Cas13a (SEQ ID NO: 104) performance in the DETECTR assay, as measured by fluorescence, for each of the five commercially available buffers and a HEPES pH 6.8 buffer (20 mM HEPES pH 6.8; 50 mM KCl; 5 mM $MgCl_2$; 10 µg/mL BSA; 100 µg/mL tRNA; 0.01% Igepal Ca-630 (NP-40); 5% Glycerol).

Combining the above described observations of buffer performance, an high performance Cas13a buffer called MBuffer1 was developed. 1× MBuffer1 include 20 mM imidazole pH 7.5, 50 mM KCl, 5 mM $MgCl_2$, 10 µg/µL BSA, 0.01% Igepal Ca-630, and 5% glycerol. FIG. 28 shows a comparison of a HEPES pH 6.8 buffer ("Original Buffer," 20 mM HEPES pH 6.8; 50 mM KCl; 5 mM $MgCl_2$; 10 µg/mL BSA; 100 µg/mL tRNA; 0.01% Igepal Ca-630 (NP-40); 5% Glycerol) to the high performance buffer ("MBuffer1," 20 mM imidazole pH 7.5, 50 mM KCl, 5 mM $MgCl_2$, 10 µg/µL BSA, 0.01% Igepal Ca-630, and 5% glycerol) for a Cas13a DETECTR assay with serially diluted target RNAs and run at 37° C. for 30 minutes. The limit of detection for the HEPES pH 6.8 buffer was around 1 pM, whereas the limit of detection for the high performance buffer was found to be between 100 fM and 10 fM. Thus, FIG. 28 demonstrates that there is a 10× and 100× improvement in assay performance using the high performance buffer.

Cas13a performance in DETECTR assays was evaluated with and without glycerol. Glycerol is commonly used in many enzymatic buffers. Cas13a detection assays with varying concentrations of target RNA were run at 37° C. for 30 minutes in either an high performance buffer with glycerol ("MBuffer1," 20 mM imidazole pH 7.5, 50 mM KCl, 5 mM $MgCl_2$, 10 µg/µL BSA, 0.01% Igepal Ca-630, and 5% glycerol) or an high performance buffer without glycerol ("MBuffer1—no glycerol," 20 mM imidazole pH 7.5, 50 mM KCl, 5 mM MgCl$_2$, 10 µg/µL BSA, and 0.01% Igepal Ca-630). FIG. 29 shows that 5% glycerol in the high performance buffer ("MBuffer1," left graph) increases performance of a Cas13a (SEQ ID NO: 104) DETECTR assay in comparison to an identical buffer without glycerol ("MBuffer1—no glycerol," right graph).

Cas13a performance in DETECTR assays was evaluated with varying concentrations of BSA and NP-40. BSA and NP-40 (Igecal-Ca 630) are used in many enzymatic buffers to increase assay performance and decrease binding of the protein to plastic surfaces. Cas13a DETECTR assays were run with 1 pM target RNA or no target RNA at 37° C. for 30 minutes in an high performance buffer with varying concentrations and combinations of NP-40 (Igepal Ca-630) and BSA. In addition to the indicated concentrations of NP-40 and BSA, each buffer contained 20 mM imidazole pH 7.5, 50 mM KCl, 5 mM MgCl$_2$, and 5% glycerol. FIG. 30 shows a gradient chart of Cas13a (SEQ ID NO: 104) activity in the DETECTR assay, as measured by fluorescence, (darker squares indicate increased Cas13a activity) versus varying NP-40 concentration along the x-axis and varying BSA concentration along the y-axis. The results indicated that both BSA and NP-40 improve the assay. NP-40 (Igecal-Ca 630) was found to be important for the efficiency of the Cas13a detection assay. Small amounts of BSA also improved the performance of the assay. Concentrations of 0.05% to 0.0625% NP-40 were most optimal and concentrations of 2.5 to 0.625 µg/mL BSA were most optimal. BSA did not improve assay performance unless NP-40 was also present.

To determine which types of compounds may increase or inhibit the performance of Cas13a in DETECTR assays, assays were run with 96 different additives (JBScreen Plus HTS, Jena Biosciences). Additives from the Jena Biosciences plate were diluted 1:66 into the final Cas13a DETECTR assay with 100 pM of target. FIG. 31 shows Cas13a performance in DETECTR assays, as measured by fluorescence, versus the different additives tested. Results showed that the specific compounds that inhibited the performance of the assay included: beryllium sulfate, manganese chloride, zinc chloride, tri-sodium citrate, copper chloride, yttrium chloride, 1-6-Diaminohexane, 1-8-diaminooctane, ammonium fluoride, ethanolamine, lithium salicylate, magnesium sulfate, potassium cyanate, and sodium fluoride.

A buffer developed for LbCas12a (SEQ ID NO: 1) used Tris pH 7.5. FIG. 32 shows the results of screening 84 different buffer and pH combinations to determine the optimal buffer for LbCas12a activity in DETECTR assays, as measured by fluorescence. A final buffer concentration of 20 mM was used for each assay. The remaining assay components included 100 mM KCl, 5 mM MgCl$_2$, 50 µg/mL heparin, 1 mM DTT, and 5% Glycerol. LbCas12a DETECTR assays were performed at 37° C. with 100 pM target DNA or no target DNA as a control. The dotted line indicates performance of LbCas12a in the Tris pH 7.5 buffer (20 mM Tris-HCl, pH 7.5; 100 mM KCl; 5 mM MgCl$_2$; 1 mM DTT; 5% glycerol; 50 µg/mL heparin). Dots indicate replicates. Results of this experiment showed that LbCas12a prefers pH 8.0 and works well in AMPD, BIS-TRISpropane, DIPSO, HEPES, MOPS, TAPS, TRIS, and tricine buffers. LbCas12a was inhibited at pH 6.5 and below and was not functional in phosphate, succinate, malonate, citrate, MES, and ADA buffers.

The optimal salt type and salt concentration was determined for LbCas12a performance in DETECTR assays. LbCas12a DETECTR assays were run with 10 pM of target DNA or no target DNA at 37° C. for 30 minutes with varying concentrations of KCl. FIG. 33 shows LbCas12a performance in DETECTR assays, as measured by fluorescence, in each of the tested conditions. Results indicated that the LbCas12a performed best in assays with low KCl concentrations (0-40 mM or less than 20 mM salt and less KCl). Above 80 mM the assay was inhibited, with little to no activity above 160 mM.

The optimal buffer type and pH was determined for the Type V CRISPR-Cas Cas12 variant (SEQ ID NO: 11) performance in DETECTR assays. FIG. 34 shows the performance of SEQ ID NO: 11 in DETECTR assays, as measured by fluorescence, for each of the tested conditions (buffer type and pH). The final concentration of buffer in each assay was 20 mM. The remaining assay components included 120 mM NaCl, 5 mM MgCl$_2$, and 1% Glycerol. SEQ ID NO: 11 DETECTR assays were performed at 37° C. with 1 nM target DNA or no target DNA (0 nM) as a control. The dotted line indicates the performance of Cas12 variant in the Tris pH 7.5 buffer (20 mM Tris-HCl, pH 7.5; 100 mM KCl; 5 mM MgCl$_2$; 1 mM DTT; 5% glycerol; 50 µg/mL heparin). Results showed that SEQ ID NO: 11 performed optimally in a pH of 7.5. High performance buffers included DIPSO, HEPES, MOPS, TAPS, imidazole, and tricine. SEQ ID NO: 11 was inhibited in Tris buffers but was still functional. SEQ ID NO: 11 showed little or no functional activity in succincate, malonate, MES, ADA, citrate, SPG, and phosphate buffers.

Further investigation of the optimal buffer type and pH was carried out for SEQ ID NO: 11. Some proteins prefer buffers that have reduced numbers of chloride ions. To determine whether SEQ ID NO: 11 performed better in chloride- or acetate-based buffers, a screen of salt type and concentration was carried out. FIG. 35 shows SEQ ID NO: 11 performance in DETECTR assays, as measured by fluorescence, for the various salt types and concentrations tested. Assay components included 20 mM HEPES pH 7.3, 1% Glycerol, and 5 mM of MgCl or MgOAc. Varying amounts of KCl or KOAc were screened with the corresponding magnesium type. SEQ ID NO: 11 detection assays were carried out at 37° C. with 1 nM target DNA and 0 nM target DNA as a control for 30 minutes. SEQ ID NO: 11 performed best at low salt concentrations of around 4 mM (ranging from 2-10 nM) and showed increased activity in buffers with MgOAc and KOAc (acetate buffers), in comparison to buffers with MgCl and KCl.

The optimal concentrations of heparin and salt concentrations were determined for SEQ ID NO: 11, since a relationship was observed between salt and heparin for SNP sensitivity using LbCas12a (SEQ ID NO: 1). The base buffer included 20 mM HEPES pH 7.3, 5 mM MgOAc, and 1% Glycerol. Varying amounts of KOAc and heparin were screened. SEQ ID NO: 11 DETECTR assays were performed at 37° C. with 1 nM target DNA or no target DNA as a control for 30 minutes. For LbCas12a heparin and salt concentrations combined to affect the specificity of the enzyme. FIG. 36 shows SEQ ID NO: 11 performance in DETECTR assays, as measured by fluorescence (darker squares indicate greater fluorescence and more activity), versus heparin concentration on the x-axis and KOAc buffer concentration on the y-axis. The results of this experiment indicated that SEQ ID NO: 11 trans-cleavage activity was inhibited by heparin and SEQ ID NO: 11 prefers low salt.

Inhibitors and enhancers of assay performance was evaluated for SEQ ID NO: 11 DETECTR assays. DETECTR assays were run with 96 different additives (JBScreen Plus HTS, Jena Biosciences). Additives from the Jena Biosciences plate were diluted 1:66 into a final SEQ ID NO: 11 detection assays with 1 nM of target. FIG. 37 shows that specific compounds inhibited the performance of the Cas12 variant (SEQ ID NO: 11) DETECTR assay including: benzamidine hydrochloride, beryllium sulfate, manganese chloride, potassium bromide, sodium iodine, zinc chloride, di-ammonium hydrogen phosphate, tri-lithium citrate, tri-sodium citrate, cadmium chloride, copper chloride, yttrium chloride, 1-6 diaminohexane, 1-8-diaminooctane, ammonium fluoride, and ammonium sulfate. Compounds that increased assay performance included: polyvinyl alcohol type II, DTT, DMSO, polyvinylpyrrolidone K15, polyethylene glycol (PEG) 600, and polypropylene glycol 400. Concentrations in the legend are listed as the stock concentration. Buffer concentrations in the assay are 2% of the concentration listed in the figure legend. In addition to the buffers indicated on the x-axis, the remaining assay components included 120 mM NaCl, 5 mM $MgCl_2$, and 1% glycerol. The dotted line indicates the performance of the Cas12 variant in the Tris pH 7.5 buffer (20 mM Tris-HCl, pH 7.5; 100 mM KCl; 5 mM $MgCl_2$; 1 mM DTT; 5% glycerol; 50 µg/mL heparin).

The positions along a target sequence most sensitive to single mutations was identified by tiling all nucleotide possibility (A, T, C, G) at the 20 positions downstream of the PAM motif along a SEQ ID NO: 11 target site on HERC2 and ALDH. FIG. 38 shows the results of evaluating SNP sensitivity along target sequences for SEQ ID NO: 11. Purple squares indicate the WT sequence that matched the crRNA was used to interrogate the sensitivity of SEQ ID NO: 11 to mutations along a target site on HERC2 and ALDH. Results indicated stronger SNP differentiation for SEQ ID NO: 11 along the 3' end of the crRNA (distal from the PAM). A similar complementary experiment using LbCas12a using the same sets of target sites and crRNAs was carried out. FIG. 39 shows the results of evaluating SNP sensitivity along target sequences for LbCas12a. LbCas12a displayed strong mutation sensitivity at all positions along HERC2, and sensitivity on the PAM proximal (complementary to the 5' end of the crRNA target sequence) on ALDH2. This suggested that LbCas12a was more sensitive to mutations in this region and that mutation sensitivity as target site dependent.

Example 9

Volumes of Sample and the Detection Reaction

This example describes volumes of sample and the detection reaction of DETECTR assays provided herein. A first volume containing a sample is provided. The first volume is contacted to a second volume. The second volume contains a guide nucleic acid, a programmable nuclease (e.g., a Cas12 or a Cas13), and a reporter. The first volume contains a sample that is unlysed, a sample that has been lysed, or a sample that has been lysed and undergone: reverse transcription, amplification, in vitro transcription, or any combination thereof. The sample contains a buffer for cell lysis, a buffer for amplification, a primer, a polymerase, target nucleic acid, a non-target nucleic acid, a single-stranded DNA, a double-stranded DNA, a salt, a buffering agent, an NTP, a dNTP, or any combination thereof. The first volume is 1 to 5 µL. The second volume is 18 to 22 µL. The programmable nuclease is able to efficiently and rapidly cleave a nucleic acid of the reporter and the detectable signal produced in the presence of a target nucleic acid sequence in the first volume is not dampened.

Example 10

Primer Design for Combined LAMP and DETECTR Reactions

This example describes primer design for combined LAMP and DETECTR reactions for amplification and detection of a target nucleic acid, as provided herein. Strategies for designing primers for use in combined LAMP and DETECTR reactions were tested and evaluated for multiple target nucleic acids. From these experiments, a set of design guidelines was determined to facilitate combined LAMP and DETECTR reactions for DNA nucleic acid targets or RT-LAMP and DETECTR reactions for RNA nucleic acid targets.

FIG. 40 shows a scheme for designing primers for loop mediated isothermal amplification (LAMP) of a target nucleic acid sequence. LAMP generates concatemer amplicons, comprising the target nucleic acid sequence, that form from nucleic acid loops during amplification. To generate the loops, LAMP may use from four to six primers, including the forward outer primer, the backward outer primer, the forward inner primer, the backward inner primer, optionally a loop forward primer, and optionally a loop backward primer.

FIG. 41 shows schematics of exemplary configurations of various regions of the nucleic acid sequence that correspond to or anneal LAMP primers, guide RNA sequences, protospacer-adjacent motif (PAM) or protospacer flanking site (PFS), and target nucleic acid sequences for amplification and detection by LAMP and DETECTR.

FIG. 41A shows a schematic of an exemplary arrangement of the guide RNA (gRNA) with respect to the various regions of nucleic acid sequence that correspond to or anneal LAMP primers. In this arrangement, the guide RNA is reverse complementary to a sequence of the target nucleic acid, which is between an F1c region and a B1 region.

FIG. 41B shows a schematic of an exemplary arrangement of the guide RNA sequence with respect to the various regions of the nucleic acid sequence that correspond to or anneal LAMP primers. In this arrangement, the guide RNA is partially reverse complementary to a sequence of the target nucleic acid, which is between an F1c region and a B1 region. For example, the target nucleic acid comprises a sequence between an F1c region and a B1 region that is reverse complementary to at least 60% of a guide nucleic acid. In this arrangement, the guide RNA is not reverse complementary to the forward inner primer or the backward inner primer shown in FIG. 40.

FIG. 41C shows a schematic of an exemplary arrangement of the guide RNA with respect to the various regions of the nucleic acid sequence that correspond to or anneal LAMP primers. In this arrangement, the guide RNA hybridizes to a sequence of the target nucleic acid, which is within the loop region between the B1 region and the B2 region. The primer sequences do not contain and are not reverse complementary to the PAM or PFS.

FIG. 41D shows a schematic of an exemplary arrangement of the guide RNA with respect to the various regions of the nucleic acid sequence that correspond to or anneal LAMP primers. In this arrangement, the guide RNA hybridizes to a sequence of the target nucleic acid, which is within the loop region between the F2c region and F1c region. The primer sequences do not contain and are not reverse complementary to the PAM or PFS.

Primer sets and guide RNAs for combined LAMP and DETECTR reactions were tested for their sensitivity and specificity to detect the presence of a target nucleic acid in a sample. DETECTR signal, measured as raw fluorescence, was measured for each LAMP primer set with each of three guide RNAs designed for the specific LAMP primer set. DETECTR signal was measured in a sample containing 10000 copies of a target nucleic acid sequence and a sample containing zero copies of a target nucleic acid sequence (negative control) for each LAMP primer and guide RNA pair.

FIG. 42 shows schematics of exemplary configurations of various regions of the nucleic acid sequence that correspond to or anneal LAMP primers, guide RNA sequences, protospacer-adjacent motif (PAM) or protospacer flanking site (PFS), and target nucleic acid sequences for combined LAMP and DETECTR for amplification and detection, respectively. At the right, the schematics also show corresponding fluorescence data using guide RNA sequences to detect the presence of a target nucleic acid sequence following amplification of the target nucleic acid using the LAMP amplification, where a fluorescence signal is the output of the DETECTR reaction and indicates presence of the target nucleic acid. Sequences and arrangements of the regions that correspond to or anneal LAMP primers, guide RNA sequences, protospacer-adjacent motif (PAM) or protospacer flanking site (PFS), and target nucleic acid sequences are illustrated in FIG. 43A-FIG. 43C. Three exemplary guide RNAs (gRNA1 (SEQ ID NO: 261), gRNA2 (SEQ ID NO: 262), and gRNA3 (SEQ ID NO: 263)) were tested in each primer configuration. Fluorescence signal from the DETECTR reactions, indicative of detection of a target nucleic acid, measured for each of the three guide RNAs was compared for two samples, one containing the target nucleic acid sequence (1000 genome copies per reaction) and a negative control (0 genome copies per reaction) that does not contain the target nucleic acid sequence. Sequences of the gRNAs and the primers are shown below in TABLE 9.

TABLE 9

Exemplary LAMP Primer and DETECTR gRNA Sets

| SEQ ID NO: | Name | Sequence |
|---|---|---|
| SEQ ID NO: 201 | IAVE-MP-set5-F3 | GCGAAAGCAGGT AGATATTGA |
| SEQ ID NO: 249 | IAVE-MP-set5-F2 | ATGAGTCTTCTA ACCGAGGT |
| SEQ ID NO: 205 | IAVE-MP-set5-LF | TGACGGGACGAT AGAGAGAA |
| SEQ ID NO: 250 | IAVE-MP-set5-F1c | TTCAAGTCTCTG CGCGATCTC |
| SEQ ID NO: 251 | IAVE-MP-set5-B1c | TTGAGGCTCTCA TGGAATGGC |
| SEQ ID NO: 206 | IAVE-MP-set5-LB | ACAAGACCAATC CTGTCACC |
| SEQ ID NO: 252 | IAVE-MP-set5-B2 | AGCGTGAACACA AATCCTAA |

TABLE 9-continued

Exemplary LAMP Primer and DETECTR gRNA Sets

| SEQ ID NO: | Name | Sequence |
|---|---|---|
| SEQ ID NO: 202 | IAVE-MP-set5-B3 | CATTCCCATTGA GGGCATT |
| SEQ ID NO: 210 | IAVE-MP-set8-F3 | TCTTCTAACCGA GGTCGAA |
| SEQ ID NO: 253 | IAVE-MP-set8-F2 | GAAGATGTCTTT GCAGGGAA |
| SEQ ID NO: 214 | IAVE-MP-set8-LF | ATTCCATGAGAG CCTCAAGATC |
| SEQ ID NO: 254 | IAVE-MP-set8-F1c | TCAGAGGTGACA GGATTGGTCT |
| SEQ ID NO: 255 | IAVE-MP-set8-B1c | TTGTGTTCACGC TCACCGTG |
| SEQ ID NO: 215 | IAVE-MP-set8-LB | GAGGACTGCAGC GTAGAC |
| SEQ ID NO: 202 | IAVE-MP-set8-B2 | CATTCCCATTGA GGGCATT |
| SEQ ID NO: 211 | IAVE-MP-set8-B3 | CTGCTCTGTCCA TGTTGTT |
| SEQ ID NO: 256 | IAVE-MP-set1-F3 | GACTTGAAGATG TCTTTGCA |
| SEQ ID NO: 257 | IAVE-MP-set1-F2 | CAGATCTTGAGG CTCTC |
| SEQ ID NO: 258 | IAVE-MP-set1-LF | GTCTTGTCTTGT CTTTAGCCA |
| SEQ ID NO: 259 | IAVE-MP-set1-F1c | TTAGTCAGAGGT GACAGGATTG |
| SEQ ID NO: 255 | IAVE-MP-set1-B1c | TTGTGTTCACGC TCACCGTG |
| SEQ ID NO: 188 | IAVE-MP-set1-LB | CAGTGAGCGAGG ACTG |
| SEQ ID NO: 260 | IAVE-MP-set1-B2 | TTTGGACAAAGC GTCTACG |
| SEQ ID NO: 184 | IAVE-MP-set1-B3 | TGTTGTTTGGGT CCCCATT |
| SEQ ID NO: 261 | gRNA1 | UUUGUGUUCACG CUCACCGUGCCC |
| SEQ ID NO: 262 | gRNA2 | UUUAGCCAUUCC AUGAGAGCCUCA |
| SEQ ID NO: 263 | gRNA3 | UUUGGACAAAGC GUCUACGCUGCA |

FIG. 42A shows a schematic of an arrangement of various regions of the nucleic acid sequence that correspond to or anneal LAMP primers (SEQ ID NO: 201, SEQ ID NO: 202, SEQ ID NO: 205, SEQ ID NO: 206, and SEQ ID NO: 249-SEQ ID NO: 252) and positions of three guide RNAs (gRNA1 (SEQ ID NO: 261), gRNA2 (SEQ ID NO: 262), and gRNA3 (SEQ ID NO: 263)) relative to the LAMP primers (at left). gRNA1 partially overlaps with the B2c region and is, thus, reverse complementary to a portion of to the B2 region. gRNA2 overlaps with the B1 region and is, thus, reverse complementary to the B1c region. gRNA3 partially overlaps with the B3 region and partially overlaps with the B2 region and is, thus, partially reverse complementary to the B3c region and partially reverse complementary to the B2c region. The complementary regions (B1, B2c, B3c, F1, F2c, and F3c) are not depicted, but correspond to the regions shown in FIG. 40. At right is a graph of fluorescence from the DETECTR reaction in the presence of 10,000 genome copies (before amplification) of the target nucleic acid or 0 genome copies of the target nucleic acid. DETECTR reactions with gRNA1 and gRNA3 exhibited low fluorescence intensity, indicating low to no detection of the target nucleic acid (right). gRNA2 produced a fluorescent signal independent of the presence of the target nucleic acid due to hybridization of gRNA2 with the B1c region of the BIP and self-activation of the guide RNA and Cas cleavage activity. Hybridization of gRNA2 with the BIP may further lead to amplification of a non-target sequence due to the formation of a primer dimer. The sequences and arrangements of the regions that correspond to or anneal LAMP primers, guide RNA sequences, protospacer-adjacent motif (PAM) or protospacer flanking site (PFS), and target nucleic acid sequences are shown in FIG. 43A.

FIG. 42B shows a schematic of an arrangement of various regions of the nucleic acid sequence that correspond to or anneal LAMP primers (SEQ ID NO: 202, SEQ ID NO: 210, SEQ ID NO: 211, SEQ ID NO: 214, SEQ ID NO: 215, SEQ ID NO: 253-SEQ ID NO: 255) and positions of three guide RNAs (gRNA1 (SEQ ID NO: 261), gRNA2 (SEQ ID NO: 262), and gRNA3 (SEQ ID NO: 263)) relative to the LAMP primers (at left). gRNA1 overlaps with the B1c region and is, thus, reverse complementary to the B1 region. gRNA2 overlaps with the LF region and is, thus, reverse complementary to the LFc region. gRNA 3 partially overlaps with the B2 region and partially overlaps with the LBc region and is, thus, partially reverse complementary to the B2c region and is partially reverse complementary to the LB region. At right is a graph of fluorescence from the DETECTR reaction in the presence of 10,000 genome copies (before amplification) of the target nucleic acid or 0 genome copies of the target nucleic acid. All three guide RNAs detected the presence of the target nucleic acid in DETECTR reactions, as evidenced by a high fluorescence signal in the presence of the target nucleic acid (right). gRNA1 also produced a non-specific fluorescent signal in the absence of the target nucleic acid due to primer-dimer formation with the BIP. gRNA2 and gRNA3 did not produce a substantial non-specific fluorescent signal. The sequences and arrangements of the regions that correspond to or anneal LAMP primers, guide RNA sequences, protospacer-adjacent motif (PAM) or protospacer flanking site (PFS), and target nucleic acid sequences are shown in FIG. 43B.

FIG. 42C shows a schematic of an arrangement of various regions of the nucleic acid sequence that correspond to or anneal LAMP primers (SEQ ID NO: 184, SEQ ID NO: 188, SEQ ID NO: 255-SEQ ID NO: 260) and positions of three guide RNAs (gRNA1 (SEQ ID NO: 261), gRNA2 (SEQ ID NO: 262), and gRNA3 (SEQ ID NO: 263)) relative to the LAMP primers (at left). gRNA1 overlaps with the B1c region and is, thus, reverse complementary to the B1 region. gRNA2 partially overlaps with the LF region and partially overlaps with the F2c region and is, thus, partially reverse complementary to the LFc region and partially reverse complementary to the F2 region. gRNA3 overlaps with the B2 and is, thus, reverse complementary to the B2c region. At right is a graph of fluorescence from the DETECTR reaction in the presence of 10,000 genome copies (before amplification) of the target nucleic acid or 0 genome copies of the target nucleic acid. gRNA2 and gRNA3 specifically detected the presence of the target nucleic acid in DETECTR reactions, as evidenced by a high fluorescence signal in the presence of the target nucleic acid and low fluorescence signal in the absence of the target nucleic acid (right). gRNA1 detected the presence of the target nucleic acid in a DETECTR reaction but also non-specifically produced a fluorescence signal in the absence of the target nucleic acid due to primer-dimer formation with the BIP, as evidenced by a high fluorescence signal in the presence of the target nucleic acid and a moderate fluorescence signal in the absence of the target nucleic acid. The sequences and arrangements of the regions that correspond to or anneal LAMP primers, guide RNA sequences, protospacer-adjacent motif (PAM) or protospacer flanking site (PFS), and target nucleic acid sequences are shown in FIG. 43C.

Example 11

Detection of a Target Nucleic Acid with Combined LAMP and DETECTR Reactions

This example describes detection of a target nucleic acid with combined LAMP and DETECTR reactions. Ten LAMP primer sets (#1-#10) for use in RT-LAMP assays were tested for sensitivity and specificity for samples containing a target nucleic acid sequence. Detection following RT-LAMP amplification was performed using either SYTO 9 detection or DETECTR. The sequences of the LAMP primers in each primer set are provided in TABLE 10.

TABLE 10

LAMP Primers for RT-LAMP Amplification and Detection

| SEQ ID NO: | Primer Name | Primer Set | Sequence |
| --- | --- | --- | --- |
| SEQ ID NO: 138 | F3 RSV-A-set13 | #1 | TGGAACAAGTTGTGGAGG |
| SEQ ID NO: 139 | B3 RSV-A-set13 | #1 | TGCAGCATCATATAGATCTTGA |
| SEQ ID NO: 140 | FIP RSV-A-set13 | #1 | TAGTGATGCTTTTGGGTTGTTCAATTGTATGAGTATGCTCAAAAATTGG |
| SEQ ID NO: 141 | BIP RSV-A-set13 | #1 | GTGTAGTATTGGGCAATGCTGCTCCTTGGTGTACCTCTGT |
| SEQ ID NO: 142 | LF RSV-A-set13 | #1 | TATGGTAGAATCCTGCTTCTCC |
| SEQ ID NO: 143 | LB RSV-A-set13 | #1 | TGGCCTAGGCATAATGGGAGA |
| SEQ ID NO: 144 | F3 RSV-A-set14 | #2 | AACAAGTTGTGGAGGTGTA |
| SEQ ID NO: 145 | B3 RSV-A-set14 | #2 | CCATTTTCTTTGAGTTGTTCAG |
| SEQ ID NO: 146 | FIP RSV-A-set14 | #2 | TAGTGATGCTTTTGGGTTGTTCAAGAGTATGCTCAAAAATTGGGTG |
| SEQ ID NO: 147 | BIP RSV-A-set14 | #2 | GTATTGGGCAATGCTGCTGGCATATAGATCTTGATTCCTTGGTG |
| SEQ ID NO: 148 | LF RSV-A-set14 | #2 | ATATGGTAGAATCCTGCTTCTC |

TABLE 10-continued

LAMP Primers for RT-LAMP Amplification and Detection

| SEQ ID NO: | Primer Name | Primer Set | Sequence |
|---|---|---|---|
| SEQ ID NO: 149 | LB RSV-A-set14 | #2 | CCTAGGCATAATGGGAGAATAC |
| SEQ ID NO: 144 | F3 RSV-A-set15 | #3 | AACAAGTTGTGGAGGTGTA |
| SEQ ID NO: 145 | B3 RSV-A-set15 | #3 | CCATTTTCTTTGAGTTGTTCAG |
| SEQ ID NO: 150 | FIP RSV-A-set15 | #3 | ATAGTGATGCTTTTGGGTTGTTCAAGTATGCTCAAAAATTGGGTG |
| SEQ ID NO: 151 | BIP RSV-A-set15 | #3 | GCTGCTGGCCTAGGCATAATGCATCATATAGATCTTGATTCCTT |
| SEQ ID NO: 406 | LF RSV-A-set15 | #3 | TATATGGTAGAATCCTGCTTCTC |
| SEQ ID NO: 152 | LB RSV-A-set15 | #3 | GGGAGAATACAGAGGTACAC |
| SEQ ID NO: 153 | F3 RSV-A-set16 | #4 | GGGTCTTAGCAAAATCAGTT |
| SEQ ID NO: 139 | B3 RSV-A-set16 | #4 | TGCAGCATCATATAGATCTTGA |
| SEQ ID NO: 154 | FIP RSV-A-set16 | #4 | GAATCCTGCTTCTCCACCCAATTGACACGCTAGTGTACAAGC |
| SEQ ID NO: 141 | BIP RSV-A-set16 | #4 | GTGTAGTATTGGGCAATGCTGCTCCTTGGTGTACCTCTGT |
| SEQ ID NO: 155 | LF RSV-A-set16 | #4 | CCTCCACAACTTGTTCCATTTCT |
| SEQ ID NO: 156 | LB RSV-A-set16 | #4 | TGGCCTAGGCATAATGGGAG |
| SEQ ID NO: 157 | F3 RSV-A-set17 | #5 | AAGCAGAAATGGAACAAGTT |
| SEQ ID NO: 145 | B3 RSV-A-set17 | #5 | CCATTTTCTTTGAGTTGTTCAG |
| SEQ ID NO: 158 | FIP RSV-A-set17 | #5 | TAGTGATGCTTTTGGGTTGTTCAGTGGAGGTGTATGAGTATGC |
| SEQ ID NO: 159 | BIP RSV-A-set17 | #5 | GTAGTATTGGGCAATGCTGCTGATATAGATCTTGATTCCTTGTG |
| SEQ ID NO: 160 | LF RSV-A-set17 | #5 | TGCTTCTCCACCCAATTTTTGA |
| SEQ ID NO: 161 | LB RSV-A-set17 | #5 | GCCTAGGCATAATGGGAGAATAC |
| SEQ ID NO: 153 | F3 RSV-A-set18 | #6 | GGGTCTTAGCAAAATCAGTT |
| SEQ ID NO: 139 | B3 RSV-A-set18 | #6 | TGCAGCATCATATAGATCTTGA |
| SEQ ID NO: 162 | FIP RSV-A-set18 | #6 | GAATCCTGCTTCTCCACCCAGACACGCTAGTGTACAAGC |
| SEQ ID NO: 141 | BIP RSV-A-set18 | #6 | GTGTAGTATTGGGCAATGCTGCTCCTTGGTGTACCTCTGT |
| SEQ ID NO: 155 | LF RSV-A-set18 | #6 | CCTCCACAACTTGTTCCATTTCT |
| SEQ ID NO: 156 | LB RSV-A-set18 | #6 | TGGCCTAGGCATAATGGGAG |
| SEQ ID NO: 163 | F3 RSV-A-set19 | #7 | TACACAGCTGCTGTTCAA |
| SEQ ID NO: 164 | B3 RSV-A-set19 | #7 | GGTAAATTTGCTGGGCATT |
| SEQ ID NO: 165 | FIP RSV-A-set19 | #7 | TTGGAACATGGGCACCCATAAATGTCCTAGAAAAGACGATG |
| SEQ ID NO: 166 | BIP RSV-A-set19 | #7 | CTAGTGAAACAAATATCCACACCCAGCACTGCACTTCTTGAGTT |
| SEQ ID NO: 167 | LF RSV-A-set19 | #7 | TTGTAAGTGATGCAGGAT |
| SEQ ID NO: 168 | LB RSV-A-set19 | #7 | AGGGACCCTCATTAAGAGTCATG |
| SEQ ID NO: 169 | F3 RSV-A-set20 | #8 | ATACACAGCTGCTGTTCA |
| SEQ ID NO: 164 | B3 RSV-A-set20 | #8 | GGTAAATTTGCTGGGCATT |
| SEQ ID NO: 170 | FIP RSV-A-set20 | #8 | TCTGCTGGCATGGATGATTGAATGTCCTAGAAAAGACGATG |
| SEQ ID NO: 166 | BIP RSV-A-set20 | #8 | CTAGTGAAACAAATATCCACACCCAGCACTGCACTTCTTGAGTT |
| SEQ ID NO: 171 | LF RSV-A-set20 | #8 | CCCATATTGTAAGTGATGCAGGAT |
| SEQ ID NO: 172 | LB RSV-A-set20 | #8 | AGGGACCCTCATTAAGAGTCAT |
| SEQ ID NO: 169 | F3 RSV-A-set21 | #9 | ATACACAGCTGCTGTTCA |
| SEQ ID NO: 173 | B3 RSV-A-set21 | #9 | TGGTAAATTTGCTGGGCAT |
| SEQ ID NO: 170 | FIP RSV-A-set21 | #9 | TCTGCTGGCATGGATGATTGAATGTCCTAGAAAAGACGATG |
| SEQ ID NO: 174 | BIP RSV-A-set21 | #9 | TGAAACAAATATCCACACCCAAGGGCACTGCACTTCTTGAGTT |
| SEQ ID NO: 175 | LF RSV-A-set21 | #9 | CCATATTGTAAGTGATGCAGGAT |

TABLE 10-continued

LAMP Primers for RT-LAMP
Amplification and Detection

| SEQ ID NO: | Primer Name | Primer Set | Sequence |
| --- | --- | --- | --- |
| SEQ ID NO: 176 | LB RSV-A-set21 | #9 | GACCCTCATTAAGAGTCATGAT |
| SEQ ID NO: 177 | F3 RSV-A-set22 | #10 | AACATACGTGAACAAACTTCA |
| SEQ ID NO: 178 | B3 RSV-A-set22 | #10 | GCACATATGGTAAATTTGCTGG |
| SEQ ID NO: 179 | FIP RSV-A-set22 | #10 | ACCCATATTGTAAGTGATGCAGGATAGGGCTCCACATACACAG |
| SEQ ID NO: 180 | BIP RSV-A-set22 | #10 | CTAGTGAAACAAATATCCACACCCAAGCACTGCACTTCTTGAG |
| SEQ ID NO: 181 | LF RSV-A-set22 | #10 | TTTCTAGGACATTGTATTGAACAGC |
| SEQ ID NO: 182 | LB RSV-A-set22 | #10 | GGGACCCTCATTAAGAGTCATG |

FIG. 44 shows the times to result of a reverse-transcription LAMP (RT-LAMP) reaction detected using a DNA binding dye. Amplification was performed using primer sets #1-#10. Sequences of the primer sets are provided in TABLE 10 LAMP amplification, measured by an increase in SYTO 9 fluorescence, was observed over time, and time to result was determined as the time to reach half maximum SYTO 9 fluorescence intensity. Time to result was compared for ten LAMP primer sets in the presence (1000 genome copies) or absence (0 genome copies) of a target sequence from an RNA virus. Primer sets, namely #1 (SEQ ID NO: 138-SEQ ID NO: 143), #7 (SEQ ID NO: 163-SEQ ID NO: 168), #8 (SEQ ID NO: 164, SEQ ID NO: 166, and SEQ ID NO: 169-SEQ ID NO: 172), and #10 (SEQ ID NO: 177-SEQ ID NO: 182), showed clear differentiation between a sample containing the target sequence and a negative control lacking the target sequence. A decreased time to result is indicative of a sample positive for the target nucleic acid sequence.

FIG. 45 shows fluorescence signal from a DETECTR reaction using a Cas12 variant (SEQ ID NO: 11) following a five-minute incubation with products from RT-LAMP reactions. Amplification was performed using primer sets #1-#10. LAMP primer sets #1-6 were designed for use with guide RNA #2 (SEQ ID NO: 240), and LAMP primer sets #7-10 were designed for use with guide RNA #1 (SEQ ID NO: 239). Sequences of primers in each primer set are provided in TABLE 10. DETECTR signal was compared for each LAMP primer set in the presence (1000 genome copies) or absence (0 genome copies) of a target sequence using either a guide RNA having a sequence corresponding to SEQ ID NO: 239 (guide RNA #1, top bar graph) or guide RNA having a sequence corresponding to SEQ ID NO: 240 (guide RNA #2, bottom bar graph). Data shows clean differentiation between reactions with the target sequence and no target control reactions when using DETECTR to differentiate between specific and non-specific LAMP amplification. The sequences of the gRNAs used in the DETECTR reaction are provided in TABLE 11.

TABLE 11

DETECTR gRNAs for RT-LAMP
Amplification with DETECTR

| SEQ ID NO: | gRNA Name | Sequence |
| --- | --- | --- |
| SEQ ID NO: 239 | gRNA #1 (R1118) | UAAUUUCUACUAAGUGUAGAUCUUAUAAAAGAACUAGCCAA |
| SEQ ID NO: 240 | gRNA #2 (R288) | UAAUUUCUACUAAGUGUAGAUACUCAAUUUCCUCACUUCUC |

Example 12

Amplifying Influenza A and B Virus Using RT-LAMP and SYTO 9

This example describes amplifying influenza A and B virus using LAMP and SYTO 9. Samples containing either 0, 100, 1000, 10,000, or 100,000 copies of an influenza A virus (IAV) or 0, 100, 1000, 10,000, or 100,000 copies of an influenza B virus (IBV) target nucleic acid sequence were subjected to RT-LAMP amplification using different sets of LAMP primers. Sets of LAMP primers (1, 2, 4, 5, 6, 7, 8, 9, 10, 11, or a negative control) were compared for their ability to specifically amplify the target nucleic acid sequence. Amplification was measured as a time to result using SYTO 9. A decreased time to result is indicative of a sample positive for the target nucleic acid sequence.

Each reaction RT-LAMP reaction was performed in the presence of 1×NEB IsoAmp Buffer, 4.5 mM $MgSO_4$, 6.4 U/μL Bst 2.0 (NEB), 0.75 μL Warmstart RTx reverse transcriptase, 1 μL 10× primer mix, and 0.2 μL SYTO 9 per 10 μL reaction in nuclease free water.

FIG. 46 shows detection of sequences from influenza A virus (IAV) using SYTO 9 (a DNA binding dye) following RT-LAMP amplification with LAMP primer sets 1, 2, 4, 5, 6, 7, 8, 9, 10, 11, or a negative control. Ten reactions were performed per primer set and reactions were performed in duplicate. Individual plots depict fluorescence intensity over time during the LAMP amplification reaction. Fluorescence from SYTO 9 was measured over time as a function of an amount of target sequence present in the reaction. Plots in rows show amplification in the presence of, from top to bottom, 0, 100, 1000, 10,000, or 100,000 copies of the target nucleic acid. Plots in columns show amplification using, from left to right, primer sets 1, 2, IBV, 4, 5, 6, 7, 8, 9, 10, and 11. Primer set 1 (SEQ ID NO: 183-SEQ ID NO: 188) shows a flat negative control curve, indicating suitability for use in LAMP amplification reactions. Primer set 2 (SEQ ID NO: 189-SEQ ID NO: 194) is well-suited for use in amplifying a target nucleic acid using LAMP. Primer set 8 (SEQ ID NO: 210-SEQ ID NO: 215) and primer set 10 (SEQ ID NO: 211, SEQ ID NO: 213-SEQ ID NO: 215, and SEQ ID NO: 219-SEQ ID NO: 220) also work well in amplifying a target nucleic acid using LAMP. Primer set 8 produces a lower negative control amplification signal than primer set 10. FIG. 48 shows the time to amplification of an IAV target sequence following LAMP amplification with different primer sets as determined from the SYTO 9 fluorescence traces shown in FIG. 46. Time to result was determined as the time to reach half maximum SYTO 9 fluorescence intensity. Amplification was detected using SYTO 9 in the presence of increasing concentrations of the target nucleic acid sequence (0, 100, 1000, 10,000, or 100,000 genome copies of the target sequence per reaction). The assay was capable of distinguishing between negative control reactions (no target sequence) and reactions containing 100,000 genome copies of the target sequence for all primer sets. The sequences of the LAMP primers in each primer set are provided in TABLE 12.

TABLE 12

Primers for Amplification and Detection of IAV and IBV Virus using RT-LAMP

| SEQ ID NO: | Primer Name | Primer Set | Sequence |
| --- | --- | --- | --- |
| SEQ ID NO: 183 | IAV-MP-F3 | #1 | GACTTGAAGATGTCTTTGC |
| SEQ ID NO: 184 | IAV-MP B3 | #1 | TGTTGTTTGGGTCCCCATT |
| SEQ ID NO: 185 | IAV-MP-FIP | #1 | TTAGTCAGAGGTGACAGGATTGCAGATCTTGAGGCTCTC |
| SEQ ID NO: 186 | IAV-MP-BIP | #1 | TTGTGTTCACGCTCACCGTGTTTGGACAAAGCGTCTACG |
| SEQ ID NO: 187 | IAV-MP FL | #1 | GTCTTGTCTTTAGCCA |
| SEQ ID NO: 188 | IAV-MP BL | #1 | CAGTGAGCGAGGACTG |
| SEQ ID NO: 189 | IAV F3 v2 | #2 | ACCGAGGTCGAAACGT |
| SEQ ID NO: 190 | IAV B3 v2 | #2 | GGTCCCCATTCCCATTG |
| SEQ ID NO: 191 | IAV FIP v2 | #2 | CAAAGACATCTTCAAGTCTCTGCGTTTTTTCTCTCTATCGTCCCGTCA |
| SEQ ID NO: 192 | IAV BIP v2 | #2 | AATGGCTAAAGACAAGACCAATCCTTTTTTGTCTACGCTGCAGTCC |
| SEQ ID NO: 193 | IAV LF v2 | #2 | CGATCTCGGCTTTGAGGG |
| SEQ ID NO: 194 | IAV LB v2 | #2 | TCACCGTGCCCAGTGAG |
| SEQ ID NO: 195 | IAV F3 v3 | #3 | CGAAAGCAGGTAGATATTGAAAG |
| SEQ ID NO: 196 | IAV B3 v3 | #3 | TCTACGCTGCAGTCCTC |
| SEQ ID NO: 197 | IAV FIP v3 | #3 | TCAAGTCTCTGCGCGATCTCTTTTTTGAGTCTTCTAACCGAGGT |
| SEQ ID NO: 198 | IAV BIP v3 | #3 | AGATGTCTTTGCAGGGAAAAACACTTTTTTCACAAATCCTAAAATCCCCTTAG |
| SEQ ID NO: 199 | IAV LF v3 | #3 | GACGATAGAGAGAACGTACGTTTC |
| SEQ ID NO: 200 | IAV LB v3 | #3 | AAGACCAATCCTGTCACCTCT |
| SEQ ID NO: 201 | IAV-set4-F3 | #4 | GCGAAAGCAGGTAGATATTGA |
| SEQ ID NO: 202 | IAV-set4-B3 | #4 | CATTCCCATTGAGGGCATT |
| SEQ ID NO: 203 | IAV-set4-FIP | #4 | CTTCAAGTCTCTGCGCGATCTATGAGTCTTCTAACCGAGGT |
| SEQ ID NO: 204 | IAV-set4-BIP | #4 | TTGAGGCTCTCATGGAATGGCAGCGTGAACACAAATCCTAA |
| SEQ ID NO: 205 | IAV-set4-LF | #4 | TGACGGGACGATAGAGAGAA |
| SEQ ID NO: 206 | IAV-set4-LB | #4 | ACAAGACCAATCCTGTCACC |
| SEQ ID NO: 201 | IAV-set5-F3 | #5 | GCGAAAGCAGGTAGATATTGA |
| SEQ ID NO: 202 | IAV-set5-B3 | #5 | CATTCCCATTGAGGGCATT |
| SEQ ID NO: 207 | IAV-set5-FIP | #5 | TTCAAGTCTCTGCGCGATCTCATGAGTCTTCTAACCGAGGT |
| SEQ ID NO: 204 | IAV-set5-BIP | #5 | TTGAGGCTCTCATGGAATGGCAGCGTGAACACAAATCCTAA |
| SEQ ID NO: 205 | IAV-set5-LF | #5 | TGACGGGACGATAGAGAGAA |

TABLE 12-continued

Primers for Amplification and Detection
of IAV and IBV Virus using RT-LAMP

| SEQ ID NO: | Primer Name | Primer Set | Sequence |
|---|---|---|---|
| SEQ ID NO: 206 | IAV-set5-LB | #5 | ACAAGACCAATCCTGTCACC |
| SEQ ID NO: 201 | IAV-set6-F3 | #6 | GCGAAAGCAGGTAGATATTGA |
| SEQ ID NO: 208 | IAV-set6-B3 | #6 | TTGGACAAAGCGTCTACG |
| SEQ ID NO: 203 | IAV-set6-FIP | #6 | CTTCAAGTCTCTGCGCGATCTATG AGTCTTCTAACCGAGGT |
| SEQ ID NO: 204 | IAV-set6-BIP | #6 | TTGAGGCTCTCATGGAATGGCAGC GTGAACACAAATCCTAA |
| SEQ ID NO: 205 | IAV-set6-LF | #6 | TGACGGGACGATAGAGAGAA |
| SEQ ID NO: 206 | IAV-set6-LB | #6 | ACAAGACCAATCCTGTCACC |
| SEQ ID NO: 201 | IAV-set7-F3 | #7 | GCGAAAGCAGGTAGATATTGA |
| SEQ ID NO: 202 | IAV-set7-B3 | #7 | CATTCCCATTGAGGGCATT |
| SEQ ID NO: 209 | IAV-set7-FIP | #7 | AAGTCTCTGCGCGATCTCGATGAG TCTTCTAACCGAGGT |
| SEQ ID NO: 204 | IAV-set7-BIP | #7 | TTGAGGCTCTCATGGAATGGCAGC GTGAACACAAATCCTAA |
| SEQ ID NO: 205 | IAV-set7-LF | #7 | TGACGGGACGATAGAGAGAA |
| SEQ ID NO: 206 | IAV-set7-LB | #7 | ACAAGACCAATCCTGTCACC |
| SEQ ID NO: 210 | IAV-set8-F3 | #8 | TCTTCTAACCGAGGTCGAA |
| SEQ ID NO: 211 | IAV-set8-B3 | #8 | CTGCTCTGTCCATGTTGTT |
| SEQ ID NO: 212 | IAV-set8-FIP | #8 | TCAGAGGTGACAGGATTGGTCTGA AGATGTCTTTGCAGGGAA |
| SEQ ID NO: 213 | IAV-set8-BIP | #8 | TTGTGTTCACGCTCACCGTCATTCC CATTGAGGGCATT |
| SEQ ID NO: 214 | IAV-set8-LF | #8 | ATTCCATGAGAGCCTCAAGATC |
| SEQ ID NO: 215 | IAV-set8-LB | #8 | GAGGACTGCAGCGTAGAC |
| SEQ ID NO: 216 | IAV-set9-F3 | #9 | TTCTCTCTATCGTCCCGTC |
| SEQ ID NO: 211 | IAV-set9-B3 | #9 | CTGCTCTGTCCATGTTGTT |
| SEQ ID NO: 217 | IAV-set9-FIP | #9 | CCCTTAGTCAGAGGTGACAGGAAC ACAGATCTTGAGGCTCT |
| SEQ ID NO: 213 | IAV-set9-BIP | #9 | TTGTGTTCACGCTCACCGTCATTCC CATTGAGGGCATT |
| SEQ ID NO: 218 | IAV-set9-LF | #9 | GGTCTTGTCTTTAGCCATTCCA |
| SEQ ID NO: 215 | IAV-set9-LB | #9 | GAGGACTGCAGCGTAGAC |
| SEQ ID NO: 219 | IAV-set10-F3 | #10 | GTCTTCTAACCGAGGTCGA |
| SEQ ID NO: 211 | IAV-set10-B3 | #10 | CTGCTCTGTCCATGTTGTT |
| SEQ ID NO: 220 | IAV-set10-FIP | #10 | GAGGTGACAGGATTGGTCTTGTTG AAGATGTCTTTGCAGGG |
| SEQ ID NO: 213 | IAV-set10-BIP | #10 | TTGTGTTCACGCTCACCGTCATTCC CATTGAGGGCATT |
| SEQ ID NO: 214 | IAV-set10-LF | #10 | ATTCCATGAGAGCCTCAAGATC |
| SEQ ID NO: 215 | IAV-set10-LB | #10 | GAGGACTGCAGCGTAGAC |
| SEQ ID NO: 221 | IAV-set11-F3 | #11 | AAGAAGACAAGAGATATGGC |

TABLE 12-continued

Primers for Amplification and Detection of IAV and IBV Virus using RT-LAMP

| SEQ ID NO: | Primer Name | Primer Set | Sequence |
|---|---|---|---|
| SEQ ID NO: 222 | IAV-set11-B3 | #11 | CAATTCGACACTAATTGATGGC |
| SEQ ID NO: 223 | IAV-set11-FIP | #11 | GTCTCCTTGCCCAATTAGCAAGCATCAATGAACTGAGCA |
| SEQ ID NO: 224 | IAV-set11-BIP | #11 | GTGGTGTTGGTAATGAAACGAAGCTGTCTGGCTGTCAGTA |
| SEQ ID NO: 225 | IAV-set11-LF | #11 | ACATTAGCCTTCTCTCCTTT |
| SEQ ID NO: 226 | IAV-set11-LB | #11 | AACGGGACTCTAGCATACT |
| SEQ ID NO: 227 | M605 F3 IBV LAMP | IBV | AGGGACATGAACAACAAAGA |
| SEQ ID NO: 228 | M606 B3 IBV LAMP | IBV | CAAGTTTAGCAACAAGCCT |
| SEQ ID NO: 229 | M607 FIP IBV LAMP | IBV | TCAGGGACAATACATTACGCATATCGATAAAGGAGGAAGTAAACACTCA |
| SEQ ID NO: 230 | M608 BIP IBV LAMP | IBV | TAAACGGAACATTCCTCAAACACCACTCTGGTCATATGCATTC |
| SEQ ID NO: 231 | M609 LF IBV LAMP | IBV | TCAAACGGAACTTCCCTTCTTTC |
| SEQ ID NO: 232 | M610 LB IBV LAMP | IBV | GGATACAAGTCCTTATCAACTCTGC |

FIG. 47 shows the time to amplification of an influenza B virus (IBV) target sequence following RT-LAMP amplification. Amplification was detected using SYTO 9 in the presence of increasing concentrations of target sequence (0, 100, 1000, 10,000, or 100,000 copies of the target sequence per reaction). RT-LAMP amplification was performed using primer set #8 (SEQ ID NO: 210-SEQ ID NO: 215), provided in TABLE 12.

Example 13

Detection of Influenza a Virus Using LAMP and DETECTR

This example describes detection of influenza A virus using LAMP and DETECTR. Samples containing an influenza A virus (IAV) target nucleic acid sequence or lacking the IAV target nucleic acid sequence were subjected to RT-LAMP amplification using different sets of LAMP primers. Sets of LAMP primers were compared for their ability to specifically amplify the target nucleic acid sequence. Presence or absence of the target nucleic acid in the sample was subsequently measured using DETECTR. DETECTR signal, measured by an increase in fluorescent signal upon activation of a programmable nuclease, was observed over time. An increase in fluorescence indicates the presence of the target nucleic acid sequence.

Each RT-LAMP reaction was performed in the presence of 1×NEB IsoAmp Buffer, 4.5 mM MgSO$_4$, 1.4 mM dNTPs (NEB), 6.4 U/µL Bst 2.0 (NEB), 1.5 µL Warmstart RTx, and 2 µL 10× primer mix per 20 µL reaction in nuclease-free water. Each DETECTR reaction was performed in the presence of 1× Processing Buffer, 250 nM crRNA, and 200 nM Sr-WT LbCas12a programmable nuclease in nuclease-free water.

FIG. 49 shows detection of target nucleic acid sequences from influenza A virus (IAV) using DETECTR following RT-LAMP amplification with LAMP primer sets 1, 2, 4, 5, 6, 7, 8, 9, 10, or a negative control. RT-LAMP amplification was performed using the primer sets provided in TABLE 12. Ten reactions were performed per primer set. DETECTR was performed with different gRNAs. The sequences of the gRNAs used in the DETECTR reaction are provided in TABLE 13. DETECTR signal was measured as a function of an amount of target sequence present in the reaction. Individual plots depict fluorescence intensity over time during DETECTR reaction following LAMP amplification. Individual traces on each plot show amplification followed by DETECTR with a guide RNA corresponding to SEQ ID NO: 241 (R283 gRNA, blue), a guide RNA corresponding to SEQ ID NO: 242 (R781 gRNA, red), a guide RNA corresponding to SEQ ID NO: 243 (R782 gRNA, green), or a guide RNA corresponding to SEQ ID NO: 244 (IBV gRNA, purple). Plots in rows show DETECTR following LAMP amplification in the presence of, from top to bottom, 0, 100, 1000, 10,000, or 100,000 copies of the target nucleic acid. Plots in columns show DETECTR following LAMP amplification using, from left to right, primer sets 1, 2, 4, 5, 6, 7, 8, 9, 10, 11, or IBV. Using primer set 1 resulted in robust amplification of the target nucleic acid by RT-LAMP. Primer set 2 was also found to be well-suited for use in combined methods of amplifying a target nucleic acid sequence by RT-LAMP and detecting the target nucleic acid sequence by DETECTR. Primer set 8 (SEQ ID NO: 210-SEQ ID NO: 215) and primer set 10 (SEQ ID NO: 211, SEQ ID NO: 213-SEQ ID NO: 215, and SEQ ID NO: 219-SEQ ID NO: 220) were well suited for use in combined RT-LAMP and DETECTR reactions when detected using the guide RNA corresponding to SEQ ID NO: 243 (gRNA R782), as indicated by robust amplification and detection of the target nucleic acid without non-specific amplification or detection in the absence of the target nucleic acid. Target nucleic acid sequences from IBV were also detected by DETECTR after RT-LAMP amplification of the target.

TABLE 13

DETECTR gRNAs for RT-LAMP Amplification with DETECTR of IAV or IBV

| SEQ ID NO: | gRNA Name | Sequence |
|---|---|---|
| SEQ ID NO: 241 | R283 | UAAUUCUACUAAGU GUAGAUUGUUCACGC UCACCGUGCCC |
| SEQ ID NO: 242 | R781 | UAAUUCUACUAAGU GUAGAUGCCAUUCCA UGAGAGCCUCA |
| SEQ ID NO: 243 | R782 | UAAUUCUACUAAGU GUAGAUGACAAAGCG UCUACGCUGCA |
| SEQ ID NO: 244 | IBV (R778) | UAAUUCUACUAAGU GUAGAUCUAACACUC UCAGGGACAAU |

Example 14

Detection of a SNP Using LAMP and DETECTR

This example describes detection of a SNP using LAMP and DETECTR. Strategies for designing primers for use in combined LAMP and DETECTR reactions to detect SNPs were tested and evaluated for multiple target SNPs. From these experiments, a set of design guidelines was determined to facilitate combined LAMP and DETECTR reactions for DNA nucleic acid targets or RT-LAMP and DETECTR reactions for RNA nucleic acid targets.

FIG. 50 shows a scheme for designing primers for LAMP amplification of a target nucleic acid sequence and detection of a single nucleotide polymorphism (SNP) in the target nucleic acid sequence. In an exemplary arrangement, the SNP of the target nucleic acid is positioned between the F1c region and the B1 region.

FIG. 51 shows schematics of exemplary arrangements of LAMP primers, guide RNA sequences, protospacer-adjacent motif (PAM) or protospacer flanking site (PFS), and target nucleic acids with a SNP for methods of LAMP amplification of a target nucleic acid and detection of the target nucleic acid using DETECTR.

FIG. 51A shows a schematic of an exemplary arrangement of the guide RNA with respect to various regions of the nucleic acid sequence that correspond to or anneal LAMP primers. In this arrangement, the PAM or PFS of the target nucleic acid is positioned between an F1c region and a B1 region. The entirety of the guide RNA sequence may be between the F1c region and the B1c region. The SNP is shown as positioned within a sequence of the target nucleic acid that hybridizes to the guide RNA.

FIG. 51B shows a schematic of an exemplary arrangement of the guide RNA sequence with respect to various regions of nucleic acid sequence that correspond to or anneal LAMP primers. In this arrangement, the PAM or PFS of the target nucleic acid is positioned between an F1c region and a B1 region and the target nucleic acid comprises a sequence between an F1c region and a B1 region that is reverse complementary to at least 60% of a guide nucleic acid. In this example, the guide RNA is not reverse complementary to the forward inner primer or the backward inner primer. The SNP is shown as positioned within a sequence of the target nucleic acid that hybridizes to the guide RNA.

FIG. 51C shows a schematic of an exemplary arrangement of the guide RNA sequence with respect to various regions of the nucleic acid sequence that correspond to or anneal LAMP primers. In this arrangement, the PAM or PFS of the target nucleic acid is positioned between the F1c region and the B1 region and the entirety of the guide RNA sequence is between the F1c region and the B1 region. The SNP is shown as positioned within a sequence of the target nucleic acid that hybridizes to the guide RNA.

FIG. 52 shows an exemplary sequence of a nucleic acid comprising two PAM sites and a HERC2 SNP. The positions of two gRNAs targeting the HERC2 A SNP allele at either position 9 with respect to a first PAM site (SEQ ID NO: 245) or at position 14 with respect to a second PAM site (SEQ ID NO: 247) are shown. The position of a SNP is indicated with a triangle. The SNP is positioned at position 9 relative to a first PAM site or position 14 relative to a second PAM site. The target sequence is shown in the figure. The top strand has a sequence of 5'-CCAGTTTCATTTGAGCAT-TAAGTGTCAAGTTCTG-3' (SEQ ID NO: 750) and the bottom strand has a sequence of 5'-CAGAACTTGACACT-TAATGCTCAAATGAAACTGG-3' (SEQ ID NO: 751).

FIG. 53 shows results from DETECTR reactions to detect a HERC2 SNP at position 9 relative to a first PAM site or position 14 relative to a second PAM site following LAMP amplification. The SNP position is indicated by a triangle. Fluorescence signal, indicative of detection of the target sequence, was measured over time in the presence of a target sequence comprising either a G SNP allele or an A SNP allele in HERC2. The target nucleic acid comprising the SNP was amplified using the primers presented in TABLE 14.

TABLE 14

LAMP Primers for Amplification and Detection of a HERC2 SNP

| SEQ ID NO: | Primer Name | Primer Set | Sequence |
|---|---|---|---|
| SEQ ID NO: 233 | M948 F3 HERC2 set3 | HERC2 | CTTGTAATCAACA TCAGGGTAA |
| SEQ ID NO: 234 | M949 B3 HERC2 set3 | HERC2 | AGAAACGACAAGT AGACCATT |
| SEQ ID NO: 235 | M950 FIP HERC2 set3 | HERC2 | CGCCTCTTGGATC AGACACATGTGTT AATACAAAGGTAC AGGA |
| SEQ ID NO: 236 | M951 BIP HERC2 set3 | HERC2 | CACGCTATCATCA TCAGGGGCTGCTT CAAGTGTATATAA ACTCAC |
| SEQ ID NO: 237 | M952 LF HERC2 set3 | HERC2 | GAGAGCCATGAAG AACAAATTCT |
| SEQ ID NO: 238 | M953 LB HERC2 set3 | HERC2 | CGAGGCTTCTCTT TGTTTTTAAT |

The target sequence was detected using a guide RNA (crRNA only) to detect either the A allele with the first PAM site (SNP Position 9, "A SNP"), the G allele with the first PAM site (SNP Position 9, "G SNP"), the A allele with the second PAM site (SNP Position 14, "A SNP") or the G allele with the second PAM site (SNP Position 14, "G SNP"). Four guide RNAs designed for each condition were used. The guide RNAs used for the detection of the two SNP alleles relative to the two PAM sites are presented in TABLE 15. The guide RNA corresponding to SEQ ID NO: 245 was designed to detect the A allele at position 9, the guide RNA corresponding to SEQ ID NO: 246 was designed to detect the G allele at position 9, the guide RNA corresponding to SEQ ID NO: 247 was designed to detect the A allele at position 14, and the guide RNA corresponding to SEQ ID NO: 248 was designed to detect the G allele at position 14. A high fluorescence signal was detected for the G allele in the presence of the position 9 G SNP guide RNA (SEQ ID NO: 246, top left) and the A allele in the presence of the position 9 A SNP guide RNA (SEQ ID NO: 245, bottom right). Minimal fluorescence signal was detected for the G allele in the presence of the position 9 A SNP guide RNA (SEQ ID NO: 245, top right) and the position 9 A allele in the presence of the G SNP guide RNA (SEQ ID NO: 246, bottom left).This indicates that the position 9 G SNP and position 9 A SNP guide RNAs show specificity for the G allele and A allele, respectively. The position 14 A SNP guide RNA (SEQ ID NO: 247) and the position 14 G SNP guide RNA (SEQ ID NO: 248) detected both alleles, as shown by high fluorescence signal when detecting the SNP with the position 14 A SNP or G SNP guide RNAs, independent of the target sequence present.

FIG. 54 shows a heatmap of fluorescence from a DETECTR reaction following LAMP amplification of the target nucleic acid sequence. The DETECTR reaction differentiated between two HERC2 SNP alleles at position 9 with respect to the PAM, using guide RNAs (crRNA only) specific for the A allele (SEQ ID NO: 245) or the G allele (SEQ ID NO: 246). Positive detection is indicated by a high fluorescence value in the DETECTR reaction. Guide RNA corresponding to SEQ ID NO: 245 was specific for A allele, as indicated by (i) a high fluorescence signal in the A SNP positive control, the HeLa sample, and Sample 2, and (ii) low fluorescence signal in the G SNP positive control, the negative control, and Sample 1. Guide RNA corresponding to SEQ ID NO: 246 was specific for G allele, as indicated by (i) a high fluorescence signal in the G SNP positive control, the HeLa sample, and Sample 1, and (ii) low fluorescence signal in the A SNP positive control, the negative control, and Sample 2. Sample 1 was homozygous for the G allele and Sample 2 was homozygous for the A allele.

TABLE 15

DETECTR Guide RNAs for Amplification and Detection of a HERC2 SNP

| SEQ ID NO: | gRNA Name | Sequence |
|---|---|---|
| SEQ ID NO: 245 | A SNP Position 9 (R570) | UAAUUUCUACUAAGUG UAGAUAGCAUUAAAUG UCAAGUUCU |
| SEQ ID NO: 246 | G SNP Position 9 (R571) | UAAUUUCUACUAAGUG UAGAUAGCAUUAAAUG UCAAGUUCU |
| SEQ ID NO: 247 | A SNP Position 14 (R1138) | UAAUUUCUACUAAGUG UAGAUAUUUGAGCAUU AAAUGUCAA |

TABLE 15-continued

DETECTR Guide RNAs for Amplification and Detection of a HERC2 SNP

| SEQ ID NO: | gRNA Name | Sequence |
|---|---|---|
| SEQ ID NO: 248 | G SNP Position 14 (R1139) | UAAUUUCUACUAAGUG UAGAUAUUUGAGCAUU AAGUGUCAA |

FIG. 55 shows combined LAMP amplification of a target nucleic acid by LAMP and detection of the target nucleic acid by DETECTR. Detection was carried out visually with DETECTR by illuminating the samples with a red LED. Each reaction contained a target nucleic acid sequence comprising a SNP allele for either a blue eye phenotype ("Blue Eye") or a brown eye phenotype ("Brown Eye"). Samples "Brown *" and "Blue *" were an A allele positive control and a G allele positive control, respectively. A position 9 guide RNA for either the brown eye phenotype (SEQ ID NO: 245, "Br") or the blue eye phenotype (SEQ ID NO: 246, "Bl") was used for each LAMP DETECTR reaction. The presence of either the blue eye allele or the brown eye allele was visually detected by eye, as shown by an increase in fluorescence in each tube containing a target nucleic acid sequence and a corresponding guide RNA. The guide RNA for the brown eye allele phenotype (SEQ ID NO: 245) was specific for the A allele, as shown by a high fluorescence signal (brighter tubes) in tubes containing the brown eye guide RNA and either the brown eye target nucleic acid or the A SNP positive control, and low fluorescence signal (darker tubes) in tubes containing the brown eye guide RNA and either the blue eye target nucleic acid or the G SNP positive control. The guide RNA for the blue eye allele (SEQ ID NO: 246) was specific for the G allele, as shown by a high fluorescence signal (brighter tubes) in tubes containing the blue eye guide RNA and either the blue eye target nucleic acid or the G SNP positive control, and low fluorescence signal (darker tubes) in tubes containing the blue eye guide RNA and either the brown eye target nucleic acid or the A SNP positive control.

Example 15

High Specificity Buffer

This example shows a high specificity buffer comprising 100 mM NaCl and 50 μg/ml heparin enhances the targeting specificity and enhanced SNP discrimination capabilities of LbCas12. FIG. 56A-FIG. 56H shows high sensitivity and high specificity buffers for LbCas12a (SEQ ID NO: 1). In the presence of 50 μg/ml heparin and 100 mM salt, Cas12a has improved targeting specificity and enhanced SNP discrimination capabilities. Target sequences were detected using a crRNA directed to the EGFR wild type sequence (SEQ ID NO: 448) or a crRNA directed to the EGFR mutant sequence (G SNP, SEQ ID NO: 449). In the absence of heparin and salt, Cas12a has improved sensitivity. For all SNP-related studies, high specificity buffer was used.

Example 16

Detection of the EGFR SNP T790M (c.2369C>T)

This example shows that Cas12a can be used to detect a single nucleotide polymorphism (SNP) versus wild-type (WT) of EGFR. The EGFR SNP detected was the SNP T790M (c.2369C>T). The sample comprised both the C SNP (WT) and the T SNP (T790M) cell free DNA EGFR DNA standards. Guide RNA sequences for Cas12a detection of the SNPs described in this example are listed in TABLE 17.

FIG. 57 shows a schematic of PCR primers and guide RNA targeting sequence for EGFR T790M SNP. The forward primer represents a PAM primer (SEQ ID NO: 396), also referred to as a PAMplification primer, which embeds a PAM sequence ('TTTV') upstream of the targeting sequence and includes a 6 nt 3' extension for priming. The PAM sequence is required for Cas12a-guide RNA to recognize the matching DNA target. In this schematic, the guide RNA was designed to target the mismatch located 7 nt downstream of the 5' end of the target sequence (SEQ ID NO: 400). This guide RNA/primer design is used for FIG. 59-FIG. 61.

FIG. 58A-FIG. 58C shows PAMplification F primers (PAM F primers) with varying 3' extensions (4 nt in FIG. 58A, 5 nt in FIG. 58B, 6 nt in FIG. 58C, SEQ ID NO: 394, SEQ ID NO: 395, and SEQ ID NO: 396, respectively) tested with guide RNA targeting T790M with a mismatch at the 7$^{th}$ position (SEQ ID NO: 400). The PAMplification F primer with 6 nt extension demonstrated optimal detection with the guide RNA. This PAMplification F primer was used for FIG. 59-FIG. 63.

FIG. 59A-FIG. 59C illustrates that Cas12 guide RNAs designed to target a wild type sequence ("WT" C SNP allele) and sequence comprising a T790M T SNP allele show specific Cas12-based detection in the presence of cognate single nucleotide polymorphism (SNP). Targets were detected with a crRNA directed to the wild type sequence (SEQ ID NO: 423) or a crRNA directed to the T SNP allele sequence (SEQ ID NO: 439). Time courses show activation of the WT or mutant crRNA only in the presence of the matching target (FIG. 59A and FIG. 59B). A heatmap represents time course data at t=60 min (FIG. 59C) n=3 technical replicates; synthetic oligo targets; bars represent mean±SD.

FIG. 60A-FIG. 60D show that Cas12a can detect down to 0.1-1% minor allele frequency (MAF) of EGFR T790M (T SNP allele) in mock cfDNA samples (Horizon Discovery), with 2 ng of total DNA input and a PCR pre-amplification step. Targets were detected with a crRNA directed to the wild type sequence (SEQ ID NO: 423) or a crRNA directed to the T SNP allele sequence (SEQ ID NO: 439). Detection of WT (C SNP allele) and mutant allele at t=90 min with low frequency EGFR standards is shown in FIG. 60A. Bar graphs of mutant allele detection only is shown in FIG. 60B. A heat map representation of WT and mutant allele detection is shown in FIG. 60C. Samples were run with n=3 replicates and statistical significance was determined by a two-tailed Student's t-test, with *p<0.05, p<0.01, *p<0.001, ****p<0.0001, and bars representing mean plus SD. FIG. 60D shows the different percentages of the WT and mutant allele in sample in a single test tube as pictorial representation of the percentage of MAF in the samples tested. The turnaround time was 90 minutes and the assay volume was 20 μL.

FIG. 61 shows limit of detection studies illustrating that 2 ng total DNA is the minimum input allowed for detection of 0.1-1% minor allele frequency (MAF) of EGFR T790M (T SNP allele) in mock cfDNA samples (Horizon Discovery) with a PCR pre-amplification step. Samples were run with n=3 replicates and statistical significance was determined by a two-tailed Student's t-test, with *p<0.05, p<0.01, *p<0.001, ****p<0.0001, and bars representing mean plus SD. Targets were detected using 7 mm guide RNA directed to T SNP allele (SEQ ID NO: 403). Targets were amplified using primers corresponding to SEQ ID NO: 396 and SEQ ID NO: 397. FIG. 62 shows a table of FIG. 61 assay parameters.

TABLE 16

DNA sequences used in this study

| Description | Sequence (5' → 3') |
|---|---|
| EGFR T790M PAMplification F primer (4 nt extension) (SEQ ID NO: 394) | TCACCTCCACCGT GTTTCTCAT |
| EGFR T790M PAMplification F primer (5 nt extension) (SEQ ID NO: 395) | TCACCTCCACCGT GTTTCTCATC |
| EGFR T790M PAMplification F primer (6 nt extension) (SEQ ID NO: 396) | TCACCTCCACCGT GTTTCTCATCA |
| EGFR T790M R primer (SEQ ID NO: 397) | GGAGCCAATATTG TCTTTGTGTTCCC |
| EGFR T790M Blocking primer (SEQ ID NO: 398) | TCATCACGCAGCT CATGC/3Phos/ |

TABLE 17

RNA sequences used in this study with LbCas12a.

| Description | Sequence |
|---|---|
| EGFR T790M C-SNP 6 mm guide RNA (SEQ ID NO: 399) | TAATTTCTACTAAGTGTAGAT CATCACGCAGCTCATGCCCT |
| EGFR T790M C-SNP 7 mm guide RNA (SEQ ID NO: 400) | TAATTTCTACTAAGTGTAGAT TCATCACGCAGCTCATGCCC |
| EGFR T790M C-SNP 8 mm guide RNA (SEQ ID NO: 401) | TAATTTCTACTAAGTGTAGAT CTCATCACGCAGCTCATGCC |
| EGFR T790M T-SNP 6 mm guide RNA (SEQ ID NO: 402) | TAATTTCTACTAAGTGTAGAT CATCATGCAGCTCATGCCCT |
| EGFR T790M T-SNP 7 mm guide RNA (SEQ ID NO: 403) | TAATTTCTACTAAGTGTAGAT TCATCATGCAGCTCATGCCC |
| EGFR T790M T-SNP 8 mm guide RNA (SEQ ID NO: 404) | TAATTTCTACTAAGTGTAGAT CTCATCATGCAGCTCATGCC |

Example 17

Amplification of EGFR SNP T790M (c.2369C>T) Using a Blocking Primer

This example shows that a blocking primer enriches a sample for a single nucleotide polymorphism (SNP) versus wild-type (WT) of EGFR. The enriched EGFR SNP was the SNP T790M (c.2369C>T). The sample comprised both the C SNP (WT) and the T SNP (T790M) cell free DNA EGFR DNA standards.

FIG. 63A shows how the blocking primer blocks the forward primer from binding to the WT nucleic acid for amplification.

FIG. 63B shows how the mutation in SNP does not result in the binding of the blocking primer, and therefore allowing the forward primer to bind to the SNP nucleic acid for amplification.

FIG. 63C and FIG. 63D show the detection of the EGFR C SNP using an input of 6 ng and the detection of the EGFR T SNP using an input of 6 ng, respectively, after amplification using the blocking primer strategy of FIG. 64A and FIG. 64B. PAMplification and blocking primers are provided in TABLE 18.

TABLE 18

Primers used in this Example

| Description | Sequence (5' → 3') |
|---|---|
| EGFR T790M PAMplification F primer (6 nt extension) (SEQ ID NO: 396) | TCACCTCCACCGTGTTT CTCATCA |
| EGFR T790M R primer (SEQ ID NO: 397) | GGAGCCAATATTGTCTT TGTGTTCCC |
| EGFR T790M Blocking primer (SEQ ID NO: 398) | TCATCACGCAGCTCATG C/3Phos/ |

Example 18

Amplification of EGFR SNP T790M (c.2369C>T) Using COLD-PCR

This example shows that a COLD-PCR enriches a sample for a single nucleotide polymorphism (SNP) versus wild-type (WT) of EGFR. The enriched EGFR SNP was the SNP T790M (c.2369C>T). The sample comprised both the C SNP (WT) and the T SNP (T790M) cell free DNA EGFR DNA standards.

FIG. 64A shows an exemplary full COLD-PCR strategy for enriching for a mutation, such as an EGFR SNP T790M (c.2369C>T).

FIG. 64B shows an exemplary full COLD-PCR strategy for enriching for a mutation, such as an EGFR SNP T790M (c.2369C>T).

FIG. 65A shows the detection of the EGFR C SNP using an input of 6 ng and a crRNA corresponding to SEQ ID NO: 423 and LbCas12a (SEQ ID NO: 1) after amplification using COLD-PCR. FIG. 65B shows the detection of the EGFR C SNP using an input of 6 ng the detection of the EGFR T SNP using an input of 6 ng and a crRNA corresponding to SEQ ID NO: 439 and LbCas12a (SEQ ID NO: 1) after amplification using COLD-PCR. COLD-PCR was performed using primers corresponding to SEQ ID NO: 396 and SEQ ID NO: 397.

Example 19

Detection of the EGFR SNP L858R (c. 573T>G)

This example shows that that Cas12a can be used to detect a single nucleotide polymorphism (SNP) versus wild-type (WT) of EGFR. The EGFR SNP detected was the SNP L858R (c.2573T>G). The sample comprised synthetic EGFR DNA standards for both WT EGFR allele with a T at position 2573 and the G SNP (a T to G missense substitution at position 2573 in the L858R locus).

FIG. 66A-FIG. 66B shows Cas12a (SEQ ID NO: 1) can detect down to 0.1-1% minor allele frequency (MAF) of EGFR L858R G SNP allele in mock cfDNA samples (Horizon Discovery), with 1 ng total DNA input and a COLD-PCR pre-amplification step. Detection of mutant (FIG. 66A) and WT (FIG. 66B) alleles at t=40 min with low frequency EGFR standards. FIG. 66A shows detection of the mutant allele using a gRNA corresponding to SEQ ID NO: 430 and FIG. 66B shows detection of the WT allele using a gRNA corresponding to SEQ ID NO: 429. n=3 replicates, two-tailed Student's t-test; *p<0.05, **p<0.01; bars represent mean plus SD. Target sequences were amplified using primers corresponding to SEQ ID NO: 450 and SEQ ID NO: 451. TABLE 19 shows the amino acid mutations (AA mutation), the change that has occurred in the nucleotide sequence (CDS mutation), the type of mutation, and the guide nucleic acid CRISPR RNA (crRNA) sequence used to detect the mutation.

TABLE 19

Guide for Detecting Various Mutations

| Exon | EGFR Mutation Group | CDS mutation | AA mutation | Type | Start | End | COS-MIC ID | Notes | Spacer sequence (RC) | Spacer sequence | LbCas12a crRNA | LbCas12a crRNA handle: |
|---|---|---|---|---|---|---|---|---|---|---|---|---|
| Exon 19 | Exon19 (WT) | WT | | | | | | | TTAAGAGA AGCAACAT CTCC (SEQ ID NO: 661) | GGAGATGTT GCTTCTCTTA A (SEQ ID NO: 688) | TAATTTCTACTA AGTGTAGATGG AGATGTTGCTTC TCTTAA (SEQ ID NO: 718) | R0292 EGFR Ex19 WT |
| | Ex19Del (28 targets from Roche cobas test) | c.2240_ 2251del12 | p.L747_ T751 > S | Complex_ deletion_ inframe | 55174777 | 55174788 | 6210 | | GCTATCAA GGAATCAT CTCC (SEQ ID NO: 662) | GGAGATGAT TCCTTGATA GC (SEQ ID NO: 689) | TAATTTCTACTA AGTGTAGATGG AGATGATTCCTT GATAGC (SEQ ID NO: 719) | R0293 EGFR Ex19 var1 |
| | | c.2239_ 2247delT TAAGAGAA | p.L747_ E749delLRE | Deletion_ In_frame | 55174776 | 55174784 | 6218 | | ATCAAGGA AGCAACAT CTCC (SEQ ID NO: 663) | GGAGATGTT GCTTCCTTG AT (SEQ ID NO: 690) | TAATTTCTACTA AGTGTAGATGG AGATGTTGCTTC CTTGAT (SEQ ID NO: 720) | R0294 EGFR Ex19 var2 |
| | | c.2238_ 2255del18 | p.E746_ S752 > D | Complex_ deletion_ inframe | 55174775 | 55174792 | 6220 | | CCCGTCGC TATCAAGG ATCC (SEQ ID NO: 664) | GGATCCTTG ATAGCGACG GG (SEQ ID NO: 691) | TAATTTCTACTA AGTGTAGATGG ATCCTTGATAGC CGACGGG (SEQ ID NO: 721) | R0295 EGFR Ex19 var3 |
| | | c.2235_ 2249del15 | p.E746_ A750delELREA (SEQ ID NO: 759) | Deletion_ In_frame | 55174772 | 55174786 | 6223 | | GTCGCTAT CAAAACAT CTCC (SEQ ID NO: 665) | GGAGATGTT TTGATAGCG AC (SEQ ID NO: 692) | TAATTTCTACTA AGTGTAGATGG AGATGTTTTGAT AGCGAC (SEQ ID NO: 722) | R0296 EGFR Ex19 var4 |
| | | c.2236_ 2250del15 | p.E746_ A750delELREA (SEQ ID NO: 759) | Deletion_ In_frame | 55174773 | 55174787 | 6225 | | GTCGCTAT CAAGACAT CTCC (SEQ ID NO: 666) | GGAGATGTC TTGATAGCG AC (SEQ ID NO: 693) | TAATTTCTACTA AGTGTAGATGG AGATGTCTTGA TAGCGAC (SEQ ID NO: 723) | R0297 EGFR Ex19 var5 |
| | | c.2239_ 2256del18 | p.L747_ S752delLREATS (SEQ ID NO: 760) | Deletion_ In_frame | 55174776 | 55174793 | 6255 | | CCCGTCGC TATCAAGG AACC (SEQ ID NO: 667) | GGTTCCTTG ATAGCGACG GG (SEQ ID NO: 694) | TAATTTCTACTA AGTGTAGATGG TTCCTTGATAGC GACGGG (SEQ ID NO: 724) | R0298 EGFR Ex19 var6 |
| | | c.2237_ 2254del18 | p.E746_ S752 > A | Complex_ deletion_ inframe | 55174774 | 55174791 | 12367 | | CCCGTCGC TATCAAGG CTCC (SEQ ID NO: 668) | GGAGCCTTG ATAGCGACG GG (SEQ ID NO: 695) | TAATTTCTACTA AGTGTAGATGG AGCCTTGATAG CGACGGG (SEQ ID NO: 725) | R0299 EGFR Ex19 var7 |
| | | c.2240_ 2254del15 | p.L747_ T751delLREAT (SEQ ID NO: 761) | Deletion_ In_frame | 55174777 | 55174791 | 12369 | | GTCGCTAT CAAGGAAT CTCC (SEQ ID NO: 669) | GGAGATTCC TTGATAGCG AC (SEQ ID NO: 696) | TAATTTCTACTA AGTGTAGATGG AGATTCCTTGAT AGCGAC (SEQ ID NO: 726) | R0300 EGFR Ex19 var8 |

TABLE 19-continued

Guide for Detecting Various Mutations

| EGFR Mutation Exon Group | CDS mutation | AA mutation | Type | Start | End | COS-MIC ID | Notes | Spacer sequence (RC) | Spacer sequence | LbCas12a crRNA | LbCas12a crRNA handle: |
|---|---|---|---|---|---|---|---|---|---|---|---|
| | c.2240_2257del18 | p.L747_P753 > S | Complex deletion inframe | 55174777 | 55174794 | 12370 | | CCCGTCGCTATCAAGGAATC (SEQ ID NO: 669) | GATTCCTTGATAGCGACGGG (SEQ ID NO: 697) | TAATTTCTACTAAGTGTAGATGATTCCTTGATAGCGACGGG (SEQ ID NO: 727) | R0301 EGFR Ex19 var9 |
| | c.2239_2248TTAAGAGAAG > C (SEQ ID NO: 762) | p.L747_A750 > P | Complex deletion inframe | 55174776 | 55174785 | 12382 | | ATCAAGGAACCACATCTCC (SEQ ID NO: 670) | GGAGATGTTGGTTCCTTGAT (SEQ ID NO: 698) | TAATTTCTACTAAGTGTAGATGGGGAGATGTTGGTTCCTTGAT (SEQ ID NO: 728) | R0302 EGFR Ex19 var10 |
| | c.2239_2251 > C | p.L747_T751 > P | Complex deletion inframe | 55174776 | 55174788 | 12383 | | GCTATCAAGGAACCATCTCC (SEQ ID NO: 671) | GGAGATGGTTCCTTGATAGC (SEQ ID NO: 699) | TAATTTCTACTAAGTGTAGATGAGATGGTTCCTTGATAGC (SEQ ID NO: 729) | R0303 EGFR Ex19 var11 |
| | c.2237_2255 > T | p.E746_S752 > V | Complex deletion inframe | 55174774 | 55174792 | 12384 | | CCCGTCGCTATCAAGGTTCC (SEQ ID NO: 672) | GGAACCTTGATAGCGACGGG (SEQ ID NO: 700) | TAATTTCTACTAAGTGTAGATGGAACCTTGATAGCGACGGG (SEQ ID NO: 730) | R0304 EGFR Ex19 var12 |
| | c.2235_2255 > AAT | p.E746_S752 > I | Complex deletion inframe | 55174772 | 55174792 | 12385 | | CCCGTCGCTATCAAAATTCC (SEQ ID NO: 673) | GGAATTTTGATAGCGACGGG (SEQ ID NO: 701) | TAATTTCTACTAAGTGTAGATGAATTTTGATAGCGACGGG (SEQ ID NO: 731) | R0305 EGFR Ex19 var13 |
| | c.2237_2252 > T | p.E746_T751 > V | Complex deletion inframe | 55174774 | 55174789 | 12386 | | GTCGCTATCAAGGTATCTCC (SEQ ID NO: 674) | GGAGATACCTTGATAGCGAC (SEQ ID NO: 702) | TAATTTCTACTAAGTGTAGATGAGATACCTTGATAGCGAC (SEQ ID NO: 732) | R0306 EGFR Ex19 var14 |
| | c.2239_2258 > CA | p.L747_P753 > Q | Complex deletion inframe | 55174776 | 55174795 | 12387 | | CCCGTCGCTATCAAGGAACA (SEQ ID NO: 675) | TGTTCCTTGATAGCGACGGG (SEQ ID NO: 703) | TAATTTCTACTAAGTGTAGATTGTTCCTTGATAGCGACGGG (SEQ ID NO: 733) | R0307 EGFR Ex19 var15 |
| | c.2239_2256 > CAA | p.E746_S752 > Q | Complex deletion inframe | 55174776 | 55174793 | 12403 | | GTCGCTATCAAGGAACAACC (SEQ ID NO: 676) | GGTTGTTCCTTGATAGCGAC (SEQ ID NO: 704) | TAATTTCTACTAAGTGTAGATGGTTGTTCCTTGATAGCGAC (SEQ ID NO: 734) | R0308 EGFR Ex19 var16 |
| | c.2237_2253 > TTGCT | p.E746_T751 > VA | Complex deletion inframe | 55174774 | 55174790 | 12416 | | GCTATCAAGGTTGCTTCTCC (SEQ ID NO: 678) | GGAGAAGCAACCTTGATAGC (SEQ ID NO: 705) | TAATTTCTACTAAGTGTAGATGAGAAGCAACCTTGATAGC (SEQ ID NO: 735) | R0309 EGFR Ex19 var17 |

TABLE 19-continued

Guide for Detecting Various Mutations

| EGFR Mutation Exon Group | CDS mutation | AA mutation | Type | Start | End | COSMIC ID | Notes | Spacer sequence (RC) | Spacer sequence | LbCas12a crRNA | LbCas12a crRNA handle: |
|---|---|---|---|---|---|---|---|---|---|---|---|
| | c.2238_2252 > GCA | p.L747_T751 > Q | Complex_deletion_inframe | 55174775 | 55174789 | 12419 | | GCTATCAA GGAGCAAT CTCC (SEQ ID NO: 679) | GGAGATTGC TCCTTGATA GC (SEQ ID NO: 706) | TAATTTCTACTA AGTGTAGATGG AGATTGCTCCTT GATAGC (SEQ ID NO: 736) | R0310 EGFR Ex19 var18 |
| | c.2238_2248 > GC | p.L747_A750 > P | Complex_deletion_inframe | 55174775 | 55174785 | 12422 | | ATCAAGGA GCCAACAT CTCC (SEQ ID NO: 680) | GGAGATGTT GGCTCCTTG AT (SEQ ID NO: 707) | TAATTTCTACTA AGTGTAGATGG AGATGTTGGCT CCTTGAT (SEQ ID NO: 737) | R0311 EGFR Ex19 var19 |
| | c.2237_2251del15 | p.E746_T751 > A | Complex_deletion_inframe | 55174774 | 55174788 | 12678 | | GTCGCTAT CAAGGCAT CTCC (SEQ ID NO: 681) | GGAGATGCC TTGATAGCG AC (SEQ ID NO: 708) | TAATTTCTACTA AGTGTAGATGG AGATGCCTTGA TAGCGAC (SEQ ID NO: 738) | R0312 EGFR Ex19 var20 |
| | c.2236_2253del18 | p.E746_T751delELREAT (SEQ ID NO: 763) | Deletion In_frame | 55174773 | 55174790 | 12728 | | CCCGTCGC TATCAAGT CTCC (SEQ ID NO: 682) | GGAGACTTG ATAGCGACG GG (SEQ ID NO: 709) | TAATTTCTACTA AGTGTAGATGG AGACTTGATAG CGACGGG (SEQ ID NO: 739) | R0313 EGFR Ex19 var21 |
| | c.2235_2248 > AAT TC | p.E746_A750 > IP | Complex_deletion_inframe | 55174772 | 55174785 | 13550 | | ATCAAAAT TCCAACAT CTCC (SEQ ID NO: 683) | GGAGATTTG AGATGTTGGA AT (SEQ ID NO: 710) | TAATTTCTACTA AGTGTAGATGG AGATGTTGGAA TTTTGAT (SEQ ID NO: 740) | R0314 EGFR Ex19 var22 |
| | c.2235_2252 > AAT | p.E746_T751 > I | Complex_deletion_inframe | 55174772 | 55174789 | 13551 | | GTCGCTAT CAAAATAT CTCC (SEQ ID NO: 684) | GGAGATATT TTGATAGCG AC (SEQ ID NO: 711) | TAATTTCTACTA AGTGTAGATGG AGATATTTTGAT AGCGAC (SEQ ID NO: 741) | R0315 EGFR Ex19 var23 |
| | c.2235_2251 > AATTC | p.E746_T751 > IP | Complex_deletion_inframe | 55174772 | 55174788 | 13552 | | GCTATCAA AATTCCAT CTCC (SEQ ID NO: 685) | GGAGATGGA ATTTGATA GC (SEQ ID NO: 712) | TAATTTCTACTA AGTGTAGATGG AGATGGAATTT GATAGC (SEQ ID NO: 742) | R0316 EGFR Ex19 var24 |
| | c.2237_2257 > TCT | p.E746_P753 > VS | Complex_deletion_inframe | 55174774 | 55174794 | 18427 | | CCCGTCGC TATCAAGG TCTC (SEQ ID NO: 686) | GAGACCTTG ATAGCGACG GG (SEQ ID NO: 713) | TAATTTCTACTA AGTGTAGATGA GACCTTGATAG CGACGGG (SEQ ID NO: 743) | R0317 EGFR Ex19 var25 |
| | c.2233_2247del15 | p.K745_E749delKELRE (SEQ ID NO: 764) | Deletion In_frame | 55174770 | 55174784 | 26038 | | GTCGCTAT CGCATAGCG CTCC (SEQ ID NO: 687) | GGAGATGTT GCGATAGCG AC (SEQ ID NO: 714) | TAATTTCTACTA AGTGTAGATGG AGATGTTGCGA TAGCGAC (SEQ ID NO: 744) | R0319 EGFR Ex19 var27 |

TABLE 19-continued

Guide for Detecting Various Mutations

| EGFR Mutation Group | Exon | CDS mutation | AA mutation | Type | Start | End | COS-MIC ID | Notes | Spacer sequence (RC) | Spacer sequence | LbCas12a crRNA | LbCas12a crRNA handle: |
|---|---|---|---|---|---|---|---|---|---|---|---|---|
| Exon 20 T790 (WT) | | WT | | | | | | Requires PAMplification | | | | |
| T790M | | c.2369C > T | p.T790M | Substitution_Missense | 55181378 | 55181378 | 6240 | Requires PAMplification | | | | |
| Exon 21 L858 (WT) | | WT | | | | | | | | GGCTGCCAA AACTGCTGG GT (SEQ ID NO: 715) | TAATTTCTACTA AGTGTAGATGG CTGGCCAAACT GCTGGGT (SEQ ID NO: 745) | R0435 EGFR L858 WT |
| L858R | | c.2573T > G | p.L858R | Substitution_Missense | 55191822 | 55191822 | 6224 | | | GGCGGGCCA AACTGCTGG GT (SEQ ID NO: 716) | TAATTTCTACTA AGTGTAGATGG CGGGCCAAACT GCTGGGT (SEQ ID NO: 746) | R0436 EGFR L858R (G-SNP) |
| L858R | | c.2573_2574TG > GT | p.L858R | Substitution_Missense | 55191822 | 55191823 | 12429 | | | GGCGTGCCA AACTGCTGG GT (SEQ ID NO: 717) | TAATTTCTACTA AGTGTAGATGG CGTGCCAAACT GCTGGGT (SEQ ID NO: 747) | R0437 EGFR L858R (GT-SNP) |

Example 20

Assessment of Guide RNAs for Detection of EGFR-Exon 19 Deletions

This example shows that Cas12a can be used to detect deletions in EGFR. The deletions detected were located in exon 19. Twenty-six guide RNAs were designed to detect deletions in exon 19 of the EGFR DNA sequence.

26 guides (SEQ ID NO: 481-SEQ ID NO: 506, shown in FIG. 67 as "Var") were designed and compared to a wild-type guide (SEQ ID NO: 480). The remaining 26 guides were used to screen 1 nM synthetic DNA twist fragments. Guide sequence are provided in TABLE 20.

TABLE 20

Wild Type and Variant gRNAs for Detection of Exon 19 Deletions

| SEQ ID NO: | Variant | gRNA Sequence |
|---|---|---|
| SEQ ID NO: 480 | EGFR Exon19 WT | UAAUUUCUACUAAGUGUAGAU GGAGAUGUUGCUUCUCUUAA |
| SEQ ID NO: 481 | EGFR Exon19 var01 | UAAUUUCUACUAAGUGUAGAU GGAGAUGAUUCCUUGAUAGC |
| SEQ ID NO: 482 | EGFR Exon19 var02 | UAAUUUCUACUAAGUGUAGAU GGAGAUGUUGCUUCCUUGAU |
| SEQ ID NO: 483 | EGFR Exon19 var03 | UAAUUUCUACUAAGUGUAGAU GGAUCCUUGAUAGCGACGGG |
| SEQ ID NO: 484 | EGFR Exon19 var04 | UAAUUUCUACUAAGUGUAGAU GGAGAUGUUUUGAUAGCGAC |
| SEQ ID NO: 485 | EGFR Exon19 var05 | UAAUUUCUACUAAGUGUAGAU GGAGAUGUCUUGAUAGCGAC |
| SEQ ID NO: 486 | EGFR Exon19 var06 | UAAUUUCUACUAAGUGUAGAU GGUUCCUUGAUAGCGACGGG |
| SEQ ID NO: 487 | EGFR Exon19 var07 | UAAUUUCUACUAAGUGUAGAU GGAGCCUUGAUAGCGACGGG |
| SEQ ID NO: 488 | EGFR Exon19 var08 | UAAUUUCUACUAAGUGUAGAU GGAGAUUCCUUGAUAGCGAC |
| SEQ ID NO: 489 | EGFR Exon19 var09 | UAAUUUCUACUAAGUGUAGAU GAUUCCUUGAUAGCGACGGG |
| SEQ ID NO: 490 | EGFR Exon19 var10 | UAAUUUCUACUAAGUGUAGAU GGAGAUGUUGGUUCCUUGAU |
| SEQ ID NO: 491 | EGFR Exon19 var11 | UAAUUUCUACUAAGUGUAGAU GGAGAUGGUUCCUUGAUAGC |
| SEQ ID NO: 492 | EGFR Exon19 var12 | UAAUUUCUACUAAGUGUAGAU GGAACCUUGAUAGCGACGGG |
| SEQ ID NO: 493 | EGFR Exon19 var13 | UAAUUUCUACUAAGUGUAGAU GGAAUUUGAUAGCGACGGG |
| SEQ ID NO: 494 | R306 EGFR Exon19 var14 | UAAUUUCUACUAAGUGUAGAU GGAGAUACCUUGAUAGCGAC |
| SEQ ID NO: 495 | EGFR Exon19 var15 | UAAUUUCUACUAAGUGUAGAU UGUUCCUUGAUAGCGACGGG |
| SEQ ID NO: 496 | EGFR Exon19 var16 | UAAUUUCUACUAAGUGUAGAU GGUUGUUCCUUGAUAGCGAC |
| SEQ ID NO: 497 | EGFR Exon19 var17 | UAAUUUCUACUAAGUGUAGAU GGAGAAGCAACCUUGAUAGC |
| SEQ ID NO: 498 | EGFR Exon19 var18 | UAAUUUCUACUAAGUGUAGAU GGAGAUUGCUCCUUGAUAGC |
| SEQ ID NO: 499 | EGFR Exon19 var19 | UAAUUUCUACUAAGUGUAGAU GGAGAUGUUGGCUCCUUGAU |
| SEQ ID NO: 500 | EGFR Exon19 var20 | UAAUUUCUACUAAGUGUAGAU GGAGAUGCCUUGAUAGCGAC |
| SEQ ID NO: 501 | EGFR Exon19 var21 | UAAUUUCUACUAAGUGUAGAU GGAGACUUGAUAGCGACGGG |
| SEQ ID NO: 502 | EGFR Exon19 var22 | UAAUUUCUACUAAGUGUAGAU GGAGAUGUUGGAAUUUUGAU |
| SEQ ID NO: 503 | EGFR Exon19 var23 | UAAUUUCUACUAAGUGUAGAU GGAGAUAUUUUGAUAGCGAC |
| SEQ ID NO: 504 | EGFR Exon19 var24 | UAAUUUCUACUAAGUGUAGAU GGAGAUGGAAUUUUGAUAGC |
| SEQ ID NO: 505 | EGFR Exon19 var25 | UAAUUUCUACUAAGUGUAGAU GAGACCUUGAUAGCGACGGG |
| SEQ ID NO: 488 | EGFR Exon19 var26 | UAAUUUCUACUAAGUGUAGAU GGAGAUUCCUUGAUAGCGAC |
| SEQ ID NO: 506 | EGFR Exon19 var27 | UAAUUUCUACUAAGUGUAGAU GGAGAUGUUGCGAUAGCGAC |

Resulting signals were measured using DNA Endonuclease Targeted CRISPR Trans Reporter (DETECTR) techniques. Two guide sequences (SEQ ID NO: 493 and SEQ ID NO: 499) showed similar detection sensitivity to wild-type (FIG. 67). The other 24 guides showed activity greater than wild-type, with three variants (SEQ ID NO: 485, SEQ ID NO: 488, and SEQ ID NO: 490) showing the highest detection sensitivity. Targets corresponding to SEQ ID NO: 452-SEQ ID NO: 477 and SEQ ID NO: 479, provided in TABLE 21, were detected.

TABLE 21

EGFR Exon 19 Deletions Wild Type and Variant Sequences

| SEQ ID NO: | Variant | gRNA Sequence |
|---|---|---|
| SEQ ID NO: 452 | EGFR-Exon19-var01 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCAAGGAATCATCTCCGAAAGCCAACAAGGAAATCCTCGATGTG AGTTTCTGCTTTGCTGTGTGGGGGTCCATGGCTCTGAACCTCAGGCC CACCTTTTCTCATGTCTGGCAGCTGCTCTGCTCTAGACCCTGCTCAT CTCCACATCCTAAATGTTCACTAGGCTAGGTGGAGGCTCAGT |
| SEQ ID NO: 453 | EGFR-Exon19-var02 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCAAGGAAGCAACATCTCCGAAAGCCAACAAGGAAATCCTCGA TGTGAGTTTCTGCTTTGCTGTGTGGGGTCCATGGCTCTGAACCTCA GGCCCACCTTTTCTCATGTCTGGCAGCTGCTCTGCTCTAGACCCTGC TCATCTCCACATCCTAAATGTTCACTAGGCTAGGTGGAGGCTCAGT G |
| SEQ ID NO: 454 | EGFR-Exon19-var03 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCAAGGATCCGAAAGCCAACAAGGAAATCCTCGATGTGAGTTTC TGCTTTGCTGTGTGGGGTCCATGGCTCTGAACCTCAGGCCCACCTT TTCTCATGTCTGGCAGCTGCTCTGCTCTAGACCCTGCTCATCTCCAC ATCCTAAATGTTCACTAGGCTAGGTGGAGGCTCAGTG |
| SEQ ID NO: 455 | EGFR-Exon19-var04 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCAAAACATCTCCGAAAGCCAACAAGGAAATCCTCGATGTGAGT TTCTGCTTTGCTGTGTGGGGTCCATGGCTCTGAACCTCAGGCCCAC CTTTTCTCATGTCTGGCAGCTGCTCTGCTCTAGACCCTGCTCATCTC CACATCCTAAATGTTCACTAGGCTAGGTGGAGGCTCAGTG |
| SEQ ID NO: 456 | EGFR-Exon19-var05 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCAAGACATCTCCGAAAGCCAACAAGGAAATCCTCGATGTGAGT TTCTGCTTTGCTGTGTGGGGTCCATGGCTCTGAACCTCAGGCCCAC CTTTTCTCATGTCTGGCAGCTGCTCTGCTCTAGACCCTGCTCATCTC CACATCCTAAATGTTCACTAGGCTAGGTGGAGGCTCAGTG |
| SEQ ID NO: 457 | EGFR-Exon19-var06 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCAAGGAACCGAAAGCCAACAAGGAAATCCTCGATGTGAGTTTC TGCTTTGCTGTGTGGGGTCCATGGCTCTGAACCTCAGGCCCACCTT TTCTCATGTCTGGCAGCTGCTCTGCTCTAGACCCTGCTCATCTCCAC ATCCTAAATGTTCACTAGGCTAGGTGGAGGCTCAGTG |
| SEQ ID NO: 458 | EGFR-Exon19-var07 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCAAGGCTCCGAAAGCCAACAAGGAAATCCTCGATGTGAGTTTC TGCTTTGCTGTGTGGGGTCCATGGCTCTGAACCTCAGGCCCACCTT TTCTCATGTCTGGCAGCTGCTCTGCTCTAGACCCTGCTCATCTCCAC ATCCTAAATGTTCACTAGGCTAGGTGGAGGCTCAGTG |
| SEQ ID NO: 459 | EGFR-Exon19-var08 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCAAGGAATCTCCGAAAGCCAACAAGGAAATCCTCGATGTGAGT TTCTGCTTTGCTGTGTGGGGTCCATGGCTCTGAACCTCAGGCCCAC CTTTTCTCATGTCTGGCAGCTGCTCTGCTCTAGACCCTGCTCATCTC CACATCCTAAATGTTCACTAGGCTAGGTGGAGGCTCAGTG |
| SEQ ID NO: 460 | EGFR-Exon19-var09 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT |

TABLE 21-continued

EGFR Exon 19 Deletions Wild Type and Variant Sequences

| SEQ ID NO: | Variant | gRNA Sequence |
|---|---|---|
| | | AGGGACTCTGGATCCCAGAAGGTGAGAAAGTTAAAATTCCCGTCGC<br>TATCAAGGAATCGAAAGCCAACAAGGAAATCCTCGATGTGAGTTTC<br>TGCTTTGCTGTGTGGGGGTCCATGGCTCTGAACCTCAGGCCCACCTT<br>TTCTCATGTCTGGCAGCTGCTCTGCTCTAGACCCTGCTCATCTCCAC<br>ATCCTAAATGTTCACTAGGCTAGGTGGAGGCTCAGTG |
| SEQ ID NO: 461 | EGFR-<br>Exon19-<br>var10 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGAACCAACATCTCCGAAAGCCAACAAGGAAATCCTCGA<br>TGTGAGTTTCTGCTTTGCTGTGTGGGGGTCCATGGCTCTGAACCTCA<br>GGCCCACCTTTTCTCATGTCTGGCAGCTGCTCTGCTCTAGACCCTGC<br>TCATCTCCACATCCTAAATGTTCACTAGGCTAGGTGGAGGCTCAGT<br>G |
| SEQ ID NO: 462 | EGFR-<br>Exon19-<br>var11 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGAACCATCTCCGAAAGCCAACAAGGAAATCCTCGATGTG<br>AGTTTCTGCTTTGCTGTGTGGGGTCCATGGCTCTGAACCTCAGGCC<br>CACCTTTTCTCATGTCTGGCAGCTGCTCTGCTCTAGACCCTGCTCAT<br>CTCCACATCCTAAATGTTCACTAGGCTAGGTGGAGGCTCAGTG |
| SEQ ID NO: 463 | EGFR-<br>Exon19-<br>var12 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGTTCCGAAAGCCAACAAGGAAATCCTCGATGTGAGTTTC<br>TGCTTTGCTGTGTGGGGGTCCATGGCTCTGAACCTCAGGCCCACCTT<br>TTCTCATGTCTGGCAGCTGCTCTGCTCTAGACCCTGCTCATCTCCAC<br>ATCCTAAATGTTCACTAGGCTAGGTGGAGGCTCAGTG |
| SEQ ID NO: 464 | EGFR-<br>Exon19-<br>var13 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAAATTCCGAAAGCCAACAAGGAAATCCTCGATGTGAGTTTC<br>TGCTTTGCTGTGTGGGGGTCCATGGCTCTGAACCTCAGGCCCACCTT<br>TTCTCATGTCTGGCAGCTGCTCTGCTCTAGACCCTGCTCATCTCCAC<br>ATCCTAAATGTTCACTAGGCTAGGTGGAGGCTCAGTG |
| SEQ ID NO: 465 | EGFR-<br>Exon19-<br>var14 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGTATCTCCGAAAGCCAACAAGGAAATCCTCGATGTGAGT<br>TTCTGCTTTGCTGTGTGGGGTCCATGGCTCTGAACCTCAGGCCCAC<br>CTTTTCTCATGTCTGGCAGCTGCTCTGCTCTAGACCCTGCTCATCTC<br>CACATCCTAAATGTTCACTAGGCTAGGTGGAGGCTCAGTG |
| SEQ ID NO: 466 | EGFR-<br>Exon19-<br>var15 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGAACAGAAAGCCAACAAGGAAATCCTCGATGTGAGTTTC<br>TGCTTTGCTGTGTGGGGGTCCATGGCTCTGAACCTCAGGCCCACCTT<br>TTCTCATGTCTGGCAGCTGCTCTGCTCTAGACCCTGCTCATCTCCAC<br>ATCCTAAATGTTCACTAGGCTAGGTGGAGGCTCAGTG |
| SEQ ID NO: 467 | EGFR-<br>Exon19-<br>var16 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGAACAACCGAAAGCCAACAAGGAAATCCTCGATGTGAG<br>TTTCTGCTTTGCTGTGTGGGGGTCCATGGCTCTGAACCTCAGGCCCA<br>CCTTTTCTCATGTCTGGCAGCTGCTCTGCTCTAGACCCTGCTCATCT<br>CCACATCCTAAATGTTCACTAGGCTAGGTGGAGGCTCAGTG |
| SEQ ID NO: 468 | EGFR-<br>Exon19-<br>var17 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGTTGCTTCTCCGAAAGCCAACAAGGAAATCCTCGATGTG<br>AGTTTCTGCTTTGCTGTGTGGGGGTCCATGGCTCTGAACCTCAGGCC |

TABLE 21-continued

EGFR Exon 19 Deletions Wild Type and Variant Sequences

| SEQ ID NO: | Variant | gRNA Sequence |
|---|---|---|
| | | CACCTTTTCTCATGTCTGGCAGCTGCTCTGCTCTAGACCCTGCTCAT<br>CTCCACATCCTAAATGTTCACTAGGCTAGGTGGAGGCTCAGTG |
| SEQ ID NO:<br>469 | EGFR-<br>Exon19-<br>var18 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGAGCAATCTCCGAAAGCCAACAAGGAAATCCTCGATGTG<br>AGTTTCTGCTTTGCTGTGTGGGGGTCCATGGCTCTGAACCTCAGGCC<br>CACCTTTTCTCATGTCTGGCAGCTGCTCTGCTCTAGACCCTGCTCAT<br>CTCCACATCCTAAATGTTCACTAGGCTAGGTGGAGGCTCAGTG |
| SEQ ID NO:<br>470 | EGFR-<br>Exon19-<br>var19 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGAGCCAACATCTCCGAAAGCCAACAAGGAAATCCTCGA<br>TGTGAGTTTCTGCTTTGCTGTGTGGGGGTCCATGGCTCTGAACCTCA<br>GGCCCACCTTTTCTCATGTCTGGCAGCTGCTCTGCTCTAGACCCTGC<br>TCATCTCCACATCCTAAATGTTCACTAGGCTAGGTGGAGGCTCAGT<br>G |
| SEQ ID NO:<br>471 | EGFR-<br>Exon19-<br>var20 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGCATCTCCGAAAGCCAACAAGGAAATCCTCGATGTGAGT<br>TTCTGCTTTGCTGTGTGGGGGTCCATGGCTCTGAACCTCAGGCCCAC<br>CTTTTCTCATGTCTGGCAGCTGCTCTGCTCTAGACCCTGCTCATCTC<br>CACATCCTAAATGTTCACTAGGCTAGGTGGAGGCTCAGTG |
| SEQ ID NO:<br>472 | EGFR-<br>Exon19-<br>var21 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGTCTCCGAAAGCCAACAAGGAAATCCTCGATGTGAGTTTC<br>TGCTTTGCTGTGTGGGGGTCCATGGCTCTGAACCTCAGGCCCACCTT<br>TTCTCATGTCTGGCAGCTGCTCTGCTCTAGACCCTGCTCATCTCCAC<br>ATCCTAAATGTTCACTAGGCTAGGTGGAGGCTCAGTG |
| SEQ ID NO:<br>473 | EGFR-<br>Exon19-<br>var22 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAAATTCCAACATCTCCGAAAGCCAACAAGGAAATCCTCGAT<br>GTGAGTTTCTGCTTTGCTGTGTGGGGGTCCATGGCTCTGAACCTCAG<br>GCCCACCTTTTCTCATGTCTGGCAGCTGCTCTGCTCTAGACCCTGCT<br>CATCTCCACATCCTAAATGTTCACTAGGCTAGGTGGAGGCTCAGTG |
| SEQ ID NO:<br>474 | EGFR-<br>Exon19-<br>var23 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAAATATCTCCGAAAGCCAACAAGGAAATCCTCGATGTGAGT<br>TTCTGCTTTGCTGTGTGGGGGTCCATGGCTCTGAACCTCAGGCCCAC<br>CTTTTCTCATGTCTGGCAGCTGCTCTGCTCTAGACCCTGCTCATCTC<br>CACATCCTAAATGTTCACTAGGCTAGGTGGAGGCTCAGTG |
| SEQ ID NO:<br>475 | EGFR-<br>Exon19-<br>var24 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAAATTCCATCTCCGAAAGCCAACAAGGAAATCCTCGATGTG<br>AGTTTCTGCTTTGCTGTGTGGGGGTCCATGGCTCTGAACCTCAGGCC<br>CACCTTTTCTCATGTCTGGCAGCTGCTCTGCTCTAGACCCTGCTCAT<br>CTCCACATCCTAAATGTTCACTAGGCTAGGTGGAGGCTCAGTG |
| SEQ ID NO:<br>476 | EGFR-<br>Exon19-<br>var25 | GAAGTGCCATTCCGCCTGACCTAGCCCCAGTGTCCCTCACCTTCGG<br>GGTGCATCGCTGGTAACATCCACCCAGATCACTGGGCAGCATGTGG<br>CACCATCTCACAATTGCCAGTTAACGTCTTCCTTCTCTCTCTGTCAT<br>AGGGACTCTGGATCCCAGAAGGTGAGAAAGTTAAAATTCCCGTCGC<br>TATCAAGGTCTCGAAAGCCAACAAGGAAATCCTCGATGTGAGTTTC<br>TGCTTTGCTGTGTGGGGGTCCATGGCTCTGAACCTCAGGCCCACCTT<br>TTCTCATGTCTGGCAGCTGCTCTGCTCTAGACCCTGCTCATCTCCAC<br>ATCCTAAATGTTCACTAGGCTAGGTGGAGGCTCAGTG |

TABLE 21-continued

EGFR Exon 19 Deletions Wild Type and Variant Sequences

| SEQ ID NO: | Variant | gRNA Sequence |
|---|---|---|
| SEQ ID NO: 477 | EGFR-Exon19-var27 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCGCAACATCTCCGAAAGCCAACAAGGAAATCCTCGATGTGAGT TTCTGCTTTGCTGTGTGGGGGTCCATGGCTCTGAACCTCAGGCCCAC CTTTTCTCATGTCTGGCAGCTGCTCTGCTCTAGACCCTGCTCATCTC CACATCCTAAATGTTCACTAGGCTAGGTGGAGGCTCAGTG |
| SEQ ID NO: 478 | EGFR-Exon19-var28 | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCAAGGAATTAAGAGAAGCAACCCTCGATGTGAGTTTCTGCTTT GCTGTGTGGGGGTCCATGGCTCTGAACCTCAGGCCCACCTTTTCTCA TGTCTGGCAGCTGCTCTGCTCTAGACCCTGCTCATCTCCACATCCTA AATGTTCACTAGGCTAGGTGGAGGCTCAGTG |
| SEQ ID NO: 479 | EGFR-Exon19-WT | GAAGTGCCATTCCGCCTGACCTAGCCCCAGTGTCCCTCACCTTCGG GGTGCATCGCTGGTAACATCCACCCAGATCACTGGGCAGCATGTGG CACCATCTCACAATTGCCAGTTAACGTCTTCCTTCTCTCTCTGTCAT AGGGACTCTGGATCCCAGAAGGTGAGAAAGTTAAAATTCCCGTCGC TATCAAGGAATTAAGAGAAGCAACATCTCCGAAAGCCAACAAGGA AATCCTCGATGTGAGTTTCTGCTTTGCTGTGTGGGGGTCCATGGCTC TGAACCTCAGGCCCACCTTTTCTCATGTCTGGCAGCTGCTCTGCTCT AGACCCTGCTCATCTCCACATCCTAAATGTTCACTAGGCTAGGTGG AGGCTCAGTG |

FIG. 67 shows a heat map of the DETECTR assays for each of the 26 guide variants ("Var") and a wild type ("WT") control tested. Fluorescence is the output of the DETECTR assay, and indicates that a Cas12a programmable nuclease (SEQ ID NO: 1) was activated by a target DNA to collaterally cleave a fluorescently labeled reporter, and is, thus, a measure of variant detection sensitivity. Guide variants detected the EGFR sequence comprising the deletion, while the WT control detected the EGFR wild type sequence. Screening was performed in the presence of 1 nM synthetic DNA twist fragments.

TABLE 19 shows the amino acid mutations (AA mutation), the change that has occurred in the nucleotide sequence (CDS mutation), the type of mutation, the start and end nucleotide positions of the deletion on the corresponding chromosome, and the guide nucleic acid CRISPR RNA (crRNA) sequence used to detect the mutation.

Example 21

PAM Forward Primer (PAMplification Primer)

This example shows the optimal PAM forward primer (also referred to as a PAMplification primer) for use in amplifying a target nucleic acid to comprise a sequence encoding a PAM.

FIG. 68A-FIG. 68B and FIG. 69A-FIG. 69B shows the PAM forward primer (also referred to as a PAMplification primer). The single nucleotide mismatch was anchored at positions 3-8 or 5-8 nt downstream of the PAM. PAMplification primers with 2 nt or 4 nt extensions at the 3' end were tested for their ability to discriminate the non-cognate target containing a single nucleotide mismatch/polymorphism (SNP). Here, a 4 nt PAMplification 3' extension is better at SNP detection compared to the 2 nt extension. The mismatch position is optimal around positions 6, 7 or 8. Primers used in this assay are provided in TABLE 22.

Example 22

Cas12 Recognizes dU-Containing PAM and Target Nucleic Acids

This example shows that Cas12 recognizes dU-containing PAM. Furthermore, a Cas12 recognizes target nucleic acids comprising dU.

FIG. 70A-FIG. 70B shows that Cas12 recognizes dU-containing PAM and target sequences from 100 nM to 10 pM. FIG. 70A: WT SNP-targeting guide RNA; FIG. 70B: mutant SNP-targeting guide RNA. Left to right for both FIG. 70A and FIG. 70B: (top left) WT sequence with dT-containing target, (top middle) mutant sequence with dT-containing target, (top right) mutant sequence with dU-containing PAM and target, (bottom left) no target, (bottom right) mutant sequence with dT-containing PAM and dU-containing target. Cas12 is capable of SNP detection with dU-containing sequences (both PAM and target) without compromising sensitivity. Primers used in this assay are provided in TABLE 22.

Example 23

Cas12 Recognizes dU-Containing Amplicons of the ALDH2 WT Allele

This example shows that Cas 12 recognizes a dU-containing amplicons of the ALDH2 WT allele. Additionally, the Cas12 was able to distinguish dU-containing amplicons of the ALDH2 WT allele and dU-containing amplicons of the ALDH2 SNP allele.

FIG. 71A-FIG. 71B shows the detection of ALDH2 WT allele from human genomic DNA (SEQ ID NO: 417) with dU-containing amplicons with Cas12. The sequence of the target is shown in FIG. 71A—the top strand has a sequence of 5'-CACACTCACAGTTTT-CACTTCAGTGTATGCCTGCAGCCCGTACTCGCC- CAACTCC-3' (SEQ ID NO: 752) and the bottom strand has a sequence of 5'-GGAGTTGGGCGAGTACGGGCTGCAGGCATA-CACTGAAGTGAAAACTGTGAGTGTG-3' (SEQ ID NO: 753). The ALDH2 gene was amplified from human saliva containing the WT allele using Taq master mix containing dUTP in place of dTTP, such that all T nucleotides with the above annotated ALDH2 target sequence has been replaced by U nucleotides. The amplicon was added directly to a Cas12 DETECTR assay. Cas12 guide RNAs targeting the ALDH2 WT allele detected only the cognate WT sequence and not the mutant allele, demonstrating that Cas12 is capable of SNP detection with dU-containing targets.

Example 24

Cas12 Recognizes dU-Containing Amplicons of at a Low Frequency

This example shows that Cas 12 recognizes a dU-containing amplicons at a low frequency.

FIG. 58A-FIG. 58C show the PAMplification primer produces dU-containing amplicons for detection of mutant sequences at low frequency. Cas12 guide RNAs were designed to target the T790M mutant allele (c.2369C>T, at guide mismatch position 7) in Horizon Discovery EGFR cfDNA standards at 0-5% minor allele frequencies (MAF) with 2 ng input DNA. PAMplification primers include 4-6 nt extensions at the 3' end downstream of the embedded PAM. n=3 technical replicates; bars represent mean±SD.

FIG. 60A-FIG. 60C show the detection of low frequency SNPs using PAMplification with 6 nt extension and dU-containing amplicons. Cas12a can detect down to 0.1-1% minor allele frequency (MAF) of EGFR T790M in mock cfDNA samples (Horizon Discovery), with 2 ng total DNA input. n=3 replicates, two-tailed Student's t-test; *p<0.05, p<0.01, *p<0.001, ****p<0.0001; bars represent mean plus SD.

Example 25

Ratio of LAMP Amplicon in Cas12 Detection Reaction

This example describes ratios of LAMP amplicon used in Cas12 detection reactions provided herein. A detection assay using a Cas12 variant (SEQ ID NO: 11) was performed in the presence of increasing amounts of LAMP amplified genomic DNA target nucleic acid sequence. The target nucleic acid sequence was amplified for 30 minutes at 60° C. using LAMP amplification. Increasing volumes of the amplified nucleic acid sequence were combined in a 20 µL Cas12 detection reaction. The Cas12 detection assay was run for 30 minutes at 37° C.

FIG. 72 shows detection of amplified HERC2 genomic DNA using a Cas12 variant (SEQ ID NO: 11) in the presence of increasing amounts of LAMP amplified DNA ("LAMP.Amplicon"). The HERC2 target was amplified from HeLa genomic DNA using LAMP amplification with the HERC2 LAMP primers shown in TABLE 14 (SEQ ID NO: 233-SEQ ID NO: 238). Each detection reaction was performed in the presence of 1 µL to 14 µL LAMP amplified DNA in 20 µL reactions. A negative control reaction was performed without LAMP amplified DNA (0 µL). Detection of the LAMP amplified DNA was quantified by fluorescence upon cleavage of a reporter (SEQ ID NO: 119 with N-terminal/ 5Alex594N/and C-terminal/3IAbRQSp/) by an activated Cas12 programmable nuclease upon binding of a guide RNA to the target LAMP amplified DNA.

The results indicated that the performance of the Cas12 detection assay was stable at 1 µL of LAMP amplified DNA in 20 µL reaction volumes up to 1 µL LAMP amplified DNA in 20 µL reaction volumes. Increasing the ratio to 12 µl, 13 µL, or 14 µL of LAMP amplicon in 20 µL reaction volumes, led to a decrease in assay performance.

TABLE 22

Primers used in Examples 21, 22, and 24

| Description | Sequence (5' → 3') |
| --- | --- |
| T790M dUTP PAM 6 mm NTS (SEQ ID NO: 408) | CTCCACCGTC/ideoxyU//ideoxy//ideoxyU/GCA/ideoxyU/CACGCAGC/ideoxyU/CA/ideoxyU/GCCC/ideoxyU//ideoxyU/TCGGCGCCTCCTGGACTAT |
| T790M dUTP PAM 6 mm TS (SEQ ID NO: 409) | ATAGTCCAGGAGGCAGCCGAAGGGCA/ideoxyU/GAGC/ideoxyU/GCG/ideoxyU/GA/ideoxyY/GCAAAGCACGGTGGAG |
| T790M dUTP 6 mm NTS SEQ ID NO: 410) | CTCCACCGTGCTTTGCA/ideoxyY/CACGCAGC/ideoxyY/CA/ideoxyU/GCCC/ideoxyU//ideoxyU/TCGGCGCCTCCTGGACTAT |
| T790M dUTP 6 mm TS (SEQ ID NO: 411) | ATAGTCCAGGAGGCAGCCGAAGGGCA/ideoxyU/GAGC/ideoxyU/GCG/ideoxyU/GA/ideoxyU/GCAAAGCACGGTGGAG |
| EGFR T790M 7 mm PAM 4 nt_F (SEQ ID NO: 394) | TCACCTCCACCGTGTTTCTCAT |
| EGFR T790M 7 mm PAM 5 nt_F (SEQ ID NO: 395) | TCACCTCCACCGTGTTTCTCATC |
| EGFR T790M 7 mm PAM 6 nt_F (SEQ ID NO: 396) | TCACCTCCACCGTGTTTCTCATCA |
| EGFR T790M std R (SEQ ID NO: 397) | GGAGCCAATATTGTCTTTGTGTTCCC |

Example 26

Addition of an Artificial PAM to LAMP FIP or BIP Primers

This example describes addition of an artificial PAM to LAMP FIP or BIP primers as described herein. An artificial PAM was added to a target nucleic sequence by LAMP amplifying the target nucleic acid using a FIP or BIP primer with the artificial PAM sequence. The PAM was inserted at different positions using different FIP primers shown in TABLE 23, with the PAM indicated by bold and underlining. This method of PAM introduction using LAMP amplification (referred to herein as PAMplification) was used to generate a target site for a CRISPR/Cas system that would not have otherwise been accessible.

duce an artificial PAM in the HERC2 target nucleic acid. PAM introduction with the FIP primer and gRNA binding sites for each corresponding PAM containing FIP primer are shown in FIG. 73. For example, an FIP primer having the PAM sequence at position 17 (17$^{th}$ nucleotide from the 5' end of the FIP primer; depicted as "PAM Pos 17") is used with a gRNA sequence for Pos 17 (5' end of gRNA is adjacent to the 5' end of the PAM sequence in the primer; depicted as "gRNA seq for Pos 17"). The target was amplified using primers corresponding to SEQ ID NO: 233-SEQ ID NO: 234 and SEQ ID NO: 236-SEQ ID NO: 238 with a variable FIP depending on the position of the artificially introduced PAM. FIPs corresponding to SEQ ID NO: 265-SEQ ID NO: 281 were used to insert artificial PAMs at position 1-position 17, respectively. The FIP corresponding to SEQ ID NO: 235 was used to amplify the target without

TABLE 23

Artificial PAM Position within LAMP Amplification FIP Primers

| SEQ ID NO: | PAM Position | Sequence |
| --- | --- | --- |
| SEQ ID NO: 235 | No PAM | CGCCTCTTGGATCAGACACATGTGTTAATACAAAGGTACAGGA |
| SEQ ID NO: 265 | Position 1 | CAAATCTTGGATCAGACACATGTGTTAATACAAAGGTACAGGA |
| SEQ ID NO: 266 | Position 2 | CCAAACTTGGATCAGACACATGTGTTAATACAAAGGTACAGGA |
| SEQ ID NO: 267 | Position 3 | CGCAAATTGGATCAGACACATGTGTTAATACAAAGGTACAGGA |
| SEQ ID NO: 268 | Position 4 | CGCCAAATGGATCAGACACATGTGTTAATACAAAGGTACAGGA |
| SEQ ID NO: 269 | Position 5 | CGCCCAAAGGATCAGACACATGTGTTAATACAAAGGTACAGGA |
| SEQ ID NO: 270 | Position 6 | CGCCTCAAAGATCAGACACATGTGTTAATACAAAGGTACAGGA |
| SEQ ID NO: 271 | Position 7 | CGCCTCCAAAATCAGACACATGTGTTAATACAAAGGTACAGGA |
| SEQ ID NO: 272 | Position 8 | CGCCTCTCAAATCAGACACATGTGTTAATACAAAGGTACAGGA |
| SEQ ID NO: 273 | Position 9 | CGCCTCTTCAAACAGACACATGTGTTAATACAAAGGTACAGGA |
| SEQ ID NO: 274 | Position 10 | CGCCTCTTGCAAAAGACACATGTGTTAATACAAAGGTACAGGA |
| SEQ ID NO: 275 | Position 11 | CGCCTCTTGGCAAAGACACATGTGTTAATACAAAGGTACAGGA |
| SEQ ID NO: 276 | Position 12 | CGCCTCTTGGACAAAACACATGTGTTAATACAAAGGTACAGGA |
| SEQ ID NO: 277 | Position 13 | CGCCTCTTGGATCAAACACATGTGTTAATACAAAGGTACAGGA |
| SEQ ID NO: 278 | Position 14 | CGCCTCTTGGATCCAAAACATGTGTTAATACAAAGGTACAGGA |
| SEQ ID NO: 279 | Position 15 | CGCCTCTTGGATCACAAACATGTGTTAATACAAAGGTACAGGA |
| SEQ ID NO: 280 | Position 16 | CGCCTCTTGGATCAGCAAAATGTGTTAATACAAAGGTACAGGA |
| SEQ ID NO: 281 | Position 17 | CGCCTCTTGGATCAGACAAATGTGTTAATACAAAGGTACAGGA |

FIG. 73 shows a schematic of addition of an artificial PAM to LAMP FIP or BIP primers. PAMs were introduced at different positions within the LAMP primer, and gRNAs were designed relative to each PAM for use in CRISPR-based detection assays of target nucleic acids. The PAM was introduced at different positions within the LAMP FIP primer, and the target nucleic acid was detected with gRNAs for each PAM position to assess the impact of PAM placement in an FIP primer on (1) the efficiency of LAMP amplification and (2) non-specific activation of trans cleavage by the primer binding to the gRNA-Cas protein complex.

FIG. 74 shows LAMP amplification of a target human genomic DNA (HERC2, SEQ ID NO: 416) with an FIP primer having PAM sequences at varying positions to introintroducing a PAM. Amplification was monitored using a SYTO9 DNA binding dye. Rate of amplification was quantified by the time to result, which was determined by the time to reach half maximum SYTO9 fluorescence intensity. Time to result was indicative of the time to reach exponential amplification. A lower time to result value indicated faster amplification. The results demonstrated that positioning the PAM sequence near the 5' end of the LAMP FIP primer led to slower amplification compared to the control FIP primer lacking a PAM. Most added PAM sequences positioned near the center of the FIP primer (from about position 6 to about position 15) showed similar amplification times compared to the control.

A HERC2 target nucleic acid with artificially inserted PAM sequences at various positions (position 1 to position 17) within the target nucleic acid were detected using a Cas12 detection assay. The HERC2 target was amplified using LAMP primers SEQ ID NO: 233, SEQ ID NO: 234, and SEQ ID NO: 235-SEQ ID NO: 238. FIP primers corresponding to SEQ ID NO: 265-SEQ ID NO: 281 were used to introduce artificial PAMs at position 1-position 17, respectively. The FIP primer corresponding to SEQ ID NO: 235 was used to amplify the target without inserting an artificial PAM. gRNAs were designed to hybridize to the target nucleic acid sequence with the PAM sequence inserted at various positions. FIG. 75 shows detection of a target nucleic acid with an artificially introduced PAM using a Cas variant (SEQ ID NO: 11). gRNAs corresponding to SEQ ID NO: 283-SEQ ID NO: 299 were used to detect target nucleic acids with artificially introduced PAMs at position 1-position 17, respectively. Sequences of the gRNAs are provided in TABLE 24. Artificial PAMs were introduced at different positions of a FIP primer, as illustrated in FIG. 73. Upon hybridization of the gRNA to the target, SEQ ID NO: 11 was activated and cleaved reporters (SEQ ID NO: 119 with N-terminal/5Alex594N/and C-terminal/3IAbRQSp/), releasing a fluorescent detectable signal. Thus, target nucleic acids were detected by measuring fluorescence. Fluorescence was measured following LAMP with genomic DNA, LAMP with no target (negative control), or a water negative control ("water control for detection assay"). The detection assay was performed at 37° C. for 90 minutes using 1 μL of the LAMP amplicon per 20 μL reaction.

Adding an artificial PAM at various positions within a LAMP FIP primer led to non-specific activation of SEQ ID NO: 11 trans cleavage activity when at least 12 nucleotides overlapped between the gRNA and the LAMP FIP primer. The degree of non-specific trans cleavage activity is expected to be impacted by the melting temperature of the overlapping gRNA and LAMP primer sequence, with a higher melting temperature leading to more non-specific trans cleavage activity.

Based on the time to amplification shown in FIG. 74 and the Cas12 detection shown in FIG. 75, the results demonstrated that artificial PAM sequences were preferably positioned away from the 5' end of the FIP (F1c region) or BIP primer (B1c region) and towards the center (position 6 to position 15) of the FIP or BIP primers. Additionally, positioning the artificial PAM such that less than 50% of the primer overlapped with the gRNA sequence decreased non-specific trans cleavage activation. The assay also showed better detection sensitivity and specificity at PAM insertion positions where fewer mutations were made in the primer to insert the artificial PAM sequence (e.g., PAMs inserted at positions 13, 15, or 17 having 1 or 2 changes relative to the wild type sequence). In contrast, detection sensitivity was lower at PAM insertion positions where more mutations were made in the primer of inset the artificial PAM sequence (e.g., PAMs inserted at positions 12 or 14 having 3 or 4 changes relative to the wild type sequence).

TABLE 24 gRNAs for Detection of Target Sequences with Artificially Introdiced PAMs

| SEQ ID NO: | PAM Position | gRNA Sequence |
| --- | --- | --- |
| SEQ ID NO: 283 | Position 1 | UAAUUUCUACUAAGUGUAGAUGCUCAAAUGAAACUGGCCU |
| SEQ ID NO: 284 | Position 2 | UAAUUUCUACUAAGUGUAGAUGCUCAAAUGAAACUGGCCUC |
| SEQ ID NO: 285 | Position 3 | UAAUUUCUACUAAGUGUAGAUCUCAAAUGAAACUGGCCUCG |
| SEQ ID NO: 286 | Position 4 | UAAUUUCUACUAAGUGUAGAUCAAAUGAAACUGGCCUCGC |
| SEQ ID NO: 287 | Position 5 | UAAUUUCUACUAAGUGUAGAUCAAAUGAAACUGGCCUCGCC |
| SEQ ID NO: 288 | Position 6 | UAAUUUCUACUAAGUGUAGAUAAAUGAAACUGGCCUCGCCU |
| SEQ ID NO: 289 | Position 7 | UAAUUUCUACUAAGUGUAGAUAAUGAAACUGGCCUCGCCUC |
| SEQ ID NO: 290 | Position 8 | UAAUUUCUACUAAGUGUAGAUAUGAAACUGGCCUCGCCUCU |
| SEQ ID NO: 291 | Position 9 | UAAUUUCUACUAAGUGUAGAUGAAACUGGCCUCGCCUCUU |
| SEQ ID NO: 292 | Position 10 | UAAUUUCUACUAAGUGUAGAUGAAACUGGCCUCGCCUCUUG |
| SEQ ID NO: 293 | Position 11 | UAAUUUCUACUAAGUGUAGAUAAACUGGCCUCGCCUCUUGG |
| SEQ ID NO: 294 | Position 12 | UAAUUUCUACUAAGUGUAGAUAACUGGCCUCGCCUCUUGGA |
| SEQ ID NO: 295 | Position 13 | UAAUUUCUACUAAGUGUAGAUACUGGCCUCGCCUCUUGGAU |
| SEQ ID NO: 296 | Position 14 | UAAUUUCUACUAAGUGUAGAUCUGGCCUCGCCUCUUGGAUC |
| SEQ ID NO: 297 | Position 15 | UAAUUUCUACUAAGUGUAGAUUGGCCUCGCCUCUUGGAUCA |
| SEQ ID NO: 298 | Position 16 | UAAUUUCUACUAAGUGUAGAUGGCCUCGCCUCUUGGAUCAG |
| SEQ ID NO: 299 | Position 17 | UAAUUUCUACUAAGUGUAGAUGCCUCGCCUCUUGGAUCAGA |

Example 27

SEQ ID NO: 11 Programmable Nuclease SNP Sensitivity Along a Target Sequence

This example describes sensitivity of a Cas12 variant programmable nuclease (SEQ ID NO: 11) to SNPs positioned along a target sequence.

In a first assay, sensitivity to point mutations in a target sequence with a native PAM site was tested. To determine which positions along a target nucleic acid sequence were most sensitive to single point mutations, all four nucleotide possibilities (A, T, C, or G) at each position were tiled along a target of a target nucleic acid sequence. The assay was performed for two target nucleic acid sequences, a HERC2 target nucleic acid sequence and an ALDH target nucleic acid sequence. Both target nucleic acid sequences comprised a native PAM site. The target nucleic acids comprising the PAM site with each of all possible point mutations were detected using a SEQ ID NO: 11 programmable nuclease. FIG. 76 shows detection of single point mutations at different positions along a nucleic acid sequence using a SEQ ID NO: 11 programmable nuclease. Point mutations to each nucleic acid (A, T, C, or G, "SNP Base (target)") were made along a target nucleic acid sequence at different positions relative to a native PAM. To determine the sensitivity of the detection assay to single point mutations (e.g., a SNP), the target nucleic acid was detected using a gRNA directed to hybridize to the wild type sequence. Black circles label with "WT" indicate the nucleotide at each position of the wild type sequence that is reverse complementary to the gRNA sequence. The assay was performed with a HERC2 target sequence (top panel, wild type sequence TCGTAATT-CACAGTTCAAGA, SEQ ID NO: 416) or an ALDH target sequence (bottom panel, wild type sequence 3'-TGAAGT-CACATACGGACGTC-5', SEQ ID NO: 417). The HERC2 sequence was detected using a gRNA corresponding to SEQ ID NO: 246 (top plot) and the ALDH sequence was detected using a gRNA corresponding to SEQ ID NO: 425 (bottom plot). Upon hybridization of gRNA to the target nucleic acid, SEQ ID NO: 11 is activated and trans cleaves a reporter (SEQ ID NO: 119 with N-terminal/56-FAM/and C-terminal/3IABkFQ/), releasing a fluorescent detectable label. Detection of target nucleic acids with SNPs was carried out by measuring fluorescence from the cleaved detectable label, and the maximum rate ("Average Max Rate") was calculated as fluorescence units per minute and averaged between four replicates. Results indicated that SEQ ID NO: 11 was sensitive to point mutations along the entire length of the gRNA target site. The specificity for individual point mutations depended on sequence context of the target nucleic acid.

In a second assay, a programmable nuclease of SEQ ID NO: 11 was used to detect variants at two SNP sites in a target nucleic acid sequence without a native PAM. The detection assay was run for 90 minutes at 37° C. with either a wild type DNA ("WT"), a target DNA with a mutation at a first SNP ("rs738408"), or a target DNA with a mutation at a second SNP ("rs738409"). FIG. 77 shows detection of two PNPLA3 SNPs in a target nucleic acid sequence without a native "TTTN" PAM sequence using a programmable nuclease of SEQ ID NO: 11. Target nucleic acids tested contained the wild type sequence ("WT"), a sequence with a mutation at a first SNP ("rs738408"), a sequence with a mutation at a second SNP ("rs738409"), or a sequence with mutations at the first SNP and the second SNP ("rs738409/408"). Target sequences are provided in TABLE 25.

TABLE 25

PNPLA3 Target Sequences

| SEQ ID NO: | Target Name | Target Sequence |
|---|---|---|
| SEQ ID NO: 412 | PNPLA3 rs738409 + rs738408 | TGCCTGCTGACTGCTCTGTAGCACAGTGCTTCGCAAAGTGTG ATCCTGGGACCAGCAGAGCAGCAGCTCCTTTGAGCTTATTGG AATGGCAGACCCTCAGGTCCCACCTCTGACCTGCTGCATGGG AATTCTGGGGAGGGACGCAGAATCTCTGGTTCCACAGGCTCT CCGGTGATGCTAATGAATACCGGCATTTGAACAGCACCGATC TAGCCCCTTTCAGTCCATGAGCCAACAACCCTTGGTCCTGTC TGTGGTGACCCAGTGTGACTCTCATGGGGAGCAAGGAGAGGA AGTTGAAGTTCACTGACAGGGTTGTTAAGGGGATTATGCAAT AGATGAGACCCATGGGCCTGAAGTCCGAGGGTGTATGTTAGT TCCCCGTTCTTTTGACCCATGGATTAACCTACTCTGTGCAAA GGGCATTTTCAAGTTTGTTGCCCTGCTCACTTGGAGAAAGCT TATGAAGGATCAGGAAAATTAAAAGGGTGCTCTCGCCTATAA CTTCTCTCTCCTTTGCTTTCACAGGCCTTGGTATGTTCCTGC TTCATGCCTTTCTACAGTGGCCTTATCCCTCCTTCCTTCAGA GGCGTGGTAAGTCGGCTTTCTCTGCTAGCGCTGAGTCCTGGG GGCCTCTGAAGTGTGCTCACACATCTCCTGCCTGCAGGGCAC TGGTGTCGGGCACCTCAGGGTCTGTCCCATGGTGGAGCCCCA TGCCTCACTGCCTTTCAGACAGAGTAGCCACAGCTGGCCCTA TTTCCAGGCTACCCGGGCAGCAAAACTTACTGCATGTGTAAT TAATTATTTGGCTATCTGTAAGGTAAACTGGCTGGTTCACTT AATCTGCACCTTAAGCATCAGATAGCTTCTCAGTGATCTAGT TAAACTATATGATGTTGGCCAGGCGCGGTGGCTCATGTCTGT AATCCCAGCACTTTGGGAGCCTGAAGCAGGCAGATCACTTGA GGTCAGGAGTTCGAGACCAGCCTGGCCAACAGTGTGAAACTC TGTCTCTCCTAAAAATACAAAAATTAGCTGGGCATGGTGGTG TGCACCTGTAATCCCAGCTGCTCGGGAGGCTGAGGCAGGAGA ATTGCTTGAACTTGGGA |
| SEQ ID NO: 413 | PNPLA3 rs738408 | TGCCTGCTGACTGCTCTGTAGCACAGTGCTTCGCAAAGTGTG ATCCTGGGACCAGCAGAGCAGCAGCTCCTTTGAGCTTATTGG AATGGCAGACCCTCAGGTCCCACCTCTGACCTGCTGCATGGG AATTCTGGGGAGGGACGCAGAATCTCTGGTTCCACAGGCTCT CCGGTGATGCTAATGAATACCGGCATTTGAACAGCACCGATC |

TABLE 25-continued

PNPLA3 Target Sequences

| SEQ ID NO: | Target Name | Target Sequence |
|---|---|---|
| | | TAGCCCCTTTCAGTCCATGAGCCAACAACCCTTGGTCCTGTC<br>TGTGGTGACCCAGTGTGACTCTCATGGGGAGCAAGGAGAGGA<br>AGTTGAAGTTCACTGACAGGGTTGTTAAGGGGATTATGCAAT<br>AGATGAGACCCATGGGCCTGAAGTCCGAGGGTGTATGTTAGT<br>TCCCCGTTCTTTTGACCCATGGATTAACCTACTCTGTGCAAA<br>GGGCATTTTCAAGTTTGTTGCCCTGCTCACTTGGAGAAAGCT<br>TATGAAGGATCAGGAAAATTAAAAGGGTGCTCTCGCCTATAA<br>CTTCTCTCTCCTTTGCTTTCACAGGCCTTGGTATGTTCCTGC<br>TTCATCCCTTTCTACAGTGGCCTTATCCCTCCTTCCTTCAGA<br>GGCGTGGTAAGTCGGCTTTCTCTGCTAGCGCTGAGTCCTGGG<br>GGCCTCTGAAGTGTGCTCACACATCTCCTGCCTGCAGGGCAC<br>TGGTGTCGGGCACCTCAGGGTCTGTCCCATGGTGGAGCCCCA<br>TGCCTCACTGCCTTTCAGACAGAGTAGCCACAGCTGGCCCTA<br>TTTCCAGGCTACCCGGGCAGCAAAACTTACTGCATGTGTAAT<br>TAATTATTTGGCTATCTGTAAGGTAAACTGGCTGGTTCACTT<br>AATCTGCACCTTAAGCATCAGATAGCTTCTCAGTGATCTAGT<br>TAAACTATATGATGTTGGCCAGGCGCGGTGGCTCATGTCTGT<br>AATCCCAGCACTTTGGGAGCCTGAAGCAGGCAGATCACTTGA<br>GGTCAGGAGTTCGAGACCAGCCTGGCCAACAGTGTGAAACTC<br>TGTCTCTCCTAAAAATACAAAAATTAGCTGGGCATGGTGGTG<br>TGCACCTGTAATCCCAGCTGCTCGGGAGGCTGAGGCAGGAGA<br>ATTGCTTGAACTTGGGA |
| SEQ ID NO: 414 | PNPLA3<br>rs738409 | TGCCTGCTGACTGCTCTGTAGCACAGTGCTTCGCAAAGTGTG<br>ATCCTGGGACCAGCAGAGCAGCAGCTCCTTTGAGCTTATTGG<br>AATGGCAGACCCTCAGGTCCCACCTCTGACCTGCTGCATGGG<br>AATTCTGGGGAGGGACGCAGAATCTCTGGTTCCACAGGCTCT<br>CCGGTGATGCTAATGAATACCGGCATTTGAACAGCACCGATC<br>TAGCCCCTTTCAGTCCATGAGCCAACAACCCTTGGTCCTGTC<br>TGTGGTGACCCAGTGTGACTCTCATGGGGAGCAAGGAGAGGA<br>AGTTGAAGTTCACTGACAGGGTTGTTAAGGGGATTATGCAAT<br>AGATGAGACCCATGGGCCTGAAGTCCGAGGGTGTATGTTAGT<br>TCCCCGTTCTTTTGACCCATGGATTAACCTACTCTGTGCAAA<br>GGGCATTTTCAAGTTTGTTGCCCTGCTCACTTGGAGAAAGCT<br>TATGAAGGATCAGGAAAATTAAAAGGGTGCTCTCGCCTATAA<br>CTTCTCTCTCCTTTGCTTTCACAGGCCTTGGTATGTTCCTGC<br>TTCATGCCCTTCTACAGTGGCCTTATCCCTCCTTCCTTCAGA<br>GGCGTGGTAAGTCGGCTTTCTCTGCTAGCGCTGAGTCCTGGG<br>GGCCTCTGAAGTGTGCTCACACATCTCCTGCCTGCAGGGCAC<br>TGGTGTCGGGCACCTCAGGGTCTGTCCCATGGTGGAGCCCCA<br>TGCCTCACTGCCTTTCAGACAGAGTAGCCACAGCTGGCCCTA<br>TTTCCAGGCTACCCGGGCAGCAAAACTTACTGCATGTGTAAT<br>TAATTATTTGGCTATCTGTAAGGTAAACTGGCTGGTTCACTT<br>AATCTGCACCTTAAGCATCAGATAGCTTCTCAGTGATCTAGT<br>TAAACTATATGATGTTGGCCAGGCGCGGTGGCTCATGTCTGT<br>AATCCCAGCACTTTGGGAGCCTGAAGCAGGCAGATCACTTGA<br>GGTCAGGAGTTCGAGACCAGCCTGGCCAACAGTGTGAAACTC<br>TGTCTCTCCTAAAAATACAAAAATTAGCTGGGCATGGTGGTG<br>TGCACCTGTAATCCCAGCTGCTCGGGAGGCTGAGGCAGGAGA<br>ATTGCTTGAACTTGGGA |
| SEQ ID NO: 415 | PNPLA3 WT | TGCCTGCTGACTGCTCTGTAGCACAGTGCTTCGCAAAGTGTG<br>ATCCTGGGACCAGCAGAGCAGCAGCTCCTTTGAGCTTATTGG<br>AATGGCAGACCCTCAGGTCCCACCTCTGACCTGCTGCATGGG<br>AATTCTGGGGAGGGACGCAGAATCTCTGGTTCCACAGGCTCT<br>CCGGTGATGCTAATGAATACCGGCATTTGAACAGCACCGATC<br>TAGCCCCTTTCAGTCCATGAGCCAACAACCCTTGGTCCTGTC<br>TGTGGTGACCCAGTGTGACTCTCATGGGGAGCAAGGAGAGGA<br>AGTTGAAGTTCACTGACAGGGTTGTTAAGGGGATTATGCAAT<br>AGATGAGACCCATGGGCCTGAAGTCCGAGGGTGTATGTTAGT<br>TCCCCGTTCTTTTGACCCATGGATTAACCTACTCTGTGCAAA<br>GGGCATTTTCAAGTTTGTTGCCCTGCTCACTTGGAGAAAGCT<br>TATGAAGGATCAGGAAAATTAAAAGGGTGCTCTCGCCTATAA<br>CTTCTCTCTCCTTTGCTTTCACAGGCCTTGGTATGTTCCTGC<br>TTCATCCCTTTCTACAGTGGCCTTATCCCTCCTTCCTTCAGA<br>GGCGTGGTAAGTCGGCTTTCTCTGCTAGCGCTGAGTCCTGGG<br>GGCCTCTGAAGTGTGCTCACACATCTCCTGCCTGCAGGGCAC<br>TGGTGTCGGGCACCTCAGGGTCTGTCCCATGGTGGAGCCCCA<br>TGCCTCACTGCCTTTCAGACAGAGTAGCCACAGCTGGCCCTA<br>TTTCCAGGCTACCCGGGCAGCAAAACTTACTGCATGTGTAAT<br>TAATTATTTGGCTATCTGTAAGGTAAACTGGCTGGTTCACTT<br>AATCTGCACCTTAAGCATCAGATAGCTTCTCAGTGATCTAGT<br>TAAACTATATGATGTTGGCCAGGCGCGGTGGCTCATGTCTGT<br>AATCCCAGCACTTTGGGAGCCTGAAGCAGGCAGATCACTTGA<br>GGTCAGGAGTTCGAGACCAGCCTGGCCAACAGTGTGAAACTC<br>TGTCTCTCCTAAAAATACAAAAATTAGCTGGGCATGGTGGTG |

TABLE 25-continued

PNPLA3 Target Sequences

| SEQ ID NO: | Target Name | Target Sequence |
|---|---|---|
| | | TGCACCTGTAATCCCAGCTGCTCGGGAGGCTGAGGCAGGAGA ATTGCTTGAACTTGGGA |

Guide RNAs were designed to detect the wild type sequence or the sequence with a mutation at the second SNP ("rs738409"), but ignore the sequence with the mutation at the first SNP ("rs738408"). Guide RNAs corresponding to SEQ ID NO: 300-SEQ ID NO: 319 were directed to the wild type (SEQ ID NO: 415, "WT") sequence on the forward strand at position 1-position 20, respectively. gRNAs corresponding to SEQ ID NO: 320-SEQ ID NO: 339 were directed to the wild type ("WT") sequence on the reverse strand at position 1-position 20, respectively. gRNAs corresponding to SEQ ID NO: 340-SEQ ID NO: 359 were directed to the mutant (SEQ ID NO: 414, "rs738409") sequence on the forward strand at position 1-position 20, respectively. gRNAs corresponding to SEQ ID NO: 360-SEQ ID NO: 379 were directed to the mutant ("rs738409") sequence on the reverse strand at position 1-position 20, respectively. Each gRNA was used to detect four different target sequences corresponding to the wild type sequence (SEQ ID NO: 415, "WT"), a sequence with a point mutation at a first site (SEQ ID NO: 413, "rs738408"), a sequence with a point mutation at a second site (SEQ ID NO: 414, "rs738409"), or a sequence with point mutations at both the first site and the second site (SEQ ID NO: 412, "rs738409+ rs738408").

Detection reactions were carried out using gRNAs designed to target different positions on the target nucleic acid relative to the position of the SNP on either the forward or reverse strand (shown on the x-axis is the position relative to the SNP on the forward or reverse strand). Upon hybridization of gRNA to the target nucleic acid, SEQ ID NO: 11 is activated and trans cleaves a reporter (SEQ ID NO: 119 with N-terminal/56-FAM/and C-terminal /3IABkFQ/), releasing a fluorescent detectable label. Detection of target nucleic acids with SNPs was carried out by measuring fluorescence from the cleaved detectable label, and the maximum rate ("Max Rate (AU/min)") was calculated as fluorescence units per minute. gRNAs that exhibited specificity for the wild type sequence ("WT") or the sequence with the mutation at the second SNP ("rs738409"), but did not non-specifically detect the sequence with the mutation at the first SNP ("rs738408"), are indicated by black arrows. Sequences of the gRNAs used are provided in TABLE 26.

TABLE 26 gRNAs for Detection of Target Sequences with Artificially Introduced PAMs

| SEQ ID NO: | Target | gRNA Sequence |
|---|---|---|
| SEQ ID NO: 300 | WT-FWD-1 | UAAUUUCUACUAAGUGUAGAUCCCCUUCUACAGUGGCCUUA |
| SEQ ID NO: 301 | WT-FWD-2 | UAAUUUCUACUAAGUGUAGAUUCCCCUUCUACAGUGGCCUU |
| SEQ ID NO: 302 | WT-FWD-3 | UAAUUUCUACUAAGUGUAGAUAUCCCCUUCUACAGUGGCCU |
| SEQ ID NO: 303 | WT-FWD-4 | UAAUUUCUACUAAGUGUAGAUCAUCCCCUUCUACAGUGGCC |
| SEQ ID NO: 304 | WT-FWD-5 | UAAUUUCUACUAAGUGUAGAUUCAUCCCCUUCUACAGUGGC |
| SEQ ID NO: 305 | WT-FWD-6 | UAAUUUCUACUAAGUGUAGAUUUCAUCCCCUUCUACAGUGG |
| SEQ ID NO: 306 | WT-FWD-7 | UAAUUUCUACUAAGUGUAGAUCUUCAUCCCCUUCUACAGUG |
| SEQ ID NO: 307 | WT-FWD-8 | UAAUUUCUACUAAGUGUAGAUGCUUCAUCCCCUUCUACAGU |
| SEQ ID NO: 308 | WT-FWD-9 | UAAUUUCUACUAAGUGUAGAUUGCUUCAUCCCCUUCUACAG |
| SEQ ID NO: 309 | WT-FWD-10 | UAAUUUCUACUAAGUGUAGAUCUGCUUCAUCCCCUUCUACA |
| SEQ ID NO: 310 | WT-FWD-11 | UAAUUUCUACUAAGUGUAGAUCCUGCUUCAUCCCCUUCUAC |
| SEQ ID NO: 311 | WT-FWD-12 | UAAUUUCUACUAAGUGUAGAUUCCUGCUUCAUCCCCUUCUA |
| SEQ ID NO: 312 | WT-FWD-13 | UAAUUUCUACUAAGUGUAGAUUUCCUGCUUCAUCCCCUUCU |
| SEQ ID NO: 313 | WT-FWD-14 | UAAUUUCUACUAAGUGUAGAUGUUCCUGCUUCAUCCCCUUC |
| SEQ ID NO: 314 | WT-FWD-15 | UAAUUUCUACUAAGUGUAGAUUGUUCCUGCUUCAUCCCCUU |
| SEQ ID NO: 315 | WT-FWD-16 | UAAUUUCUACUAAGUGUAGAUAUGUUCCUGCUUCAUCCCCU |
| SEQ ID NO: 316 | WT-FWD-17 | UAAUUUCUACUAAGUGUAGAUUAUGUUCCUGCUUCAUCCCC |
| SEQ ID NO: 317 | WT-FWD-18 | UAAUUUCUACUAAGUGUAGAUGUAUGUUCCUGCUUCAUCCC |

TABLE 26-continued gRNAs for Detection of Target Sequences
with Artificially Introduced PAMs

| SEQ ID NO: | Target | gRNA Sequence |
| --- | --- | --- |
| SEQ ID NO: 318 | WT-FWD-19 | UAAUUUCUACUAAGUGUAGAUGGUAUGUUCCUGCUUCAUCC |
| SEQ ID NO: 319 | WT-FWD-20 | UAAUUUCUACUAAGUGUAGAUUGGUAUGUUCCUGCUUCAUC |
| SEQ ID NO: 320 | WT-REV-1 | UAAUUUCUACUAAGUGUAGAUGAUGAAGCAGGAACAUACCA |
| SEQ ID NO: 321 | WT-REV-2 | UAAUUUCUACUAAGUGUAGAUGGAUGAAGCAGGAACAUACC |
| SEQ ID NO: 322 | WT-REV-3 | UAAUUUCUACUAAGUGUAGAUGGGAUGAAGCAGGAACAUAC |
| SEQ ID NO: 323 | WT-REV-4 | UAAUUUCUACUAAGUGUAGAUGGGGAUGAAGCAGGAACAUA |
| SEQ ID NO: 324 | WT-REV-5 | UAAUUUCUACUAAGUGUAGAUAGGGGAUGAAGCAGGAACAU |
| SEQ ID NO: 325 | WT-REV-6 | UAAUUUCUACUAAGUGUAGAUAAGGGGAUGAAGCAGGAACA |
| SEQ ID NO: 326 | WT-REV-7 | UAAUUUCUACUAAGUGUAGAUGAAGGGGAUGAAGCAGGAAC |
| SEQ ID NO: 327 | WT-REV-8 | UAAUUUCUACUAAGUGUAGAUAGAAGGGGAUGAAGCAGGAA |
| SEQ ID NO: 328 | WT-REV-9 | UAAUUUCUACUAAGUGUAGAUUAGAAGGGGAUGAAGCAGGA |
| SEQ ID NO: 329 | WT-REV-10 | UAAUUUCUACUAAGUGUAGAUGUAGAAGGGGAUGAAGCAGG |
| SEQ ID NO: 330 | WT-REV-11 | UAAUUUCUACUAAGUGUAGAUUGUAGAAGGGGAUGAAGCAG |
| SEQ ID NO: 331 | WT-REV-12 | UAAUUUCUACUAAGUGUAGAUCUGUAGAAGGGGAUGAAGCA |
| SEQ ID NO: 332 | WT-REV-13 | UAAUUUCUACUAAGUGUAGAUACUGUAGAAGGGGAUGAAGC |
| SEQ ID NO: 333 | WT-REV-14 | UAAUUUCUACUAAGUGUAGAUCACUGUAGAAGGGGAUGAAG |
| SEQ ID NO: 334 | WT-REV-15 | UAAUUUCUACUAAGUGUAGAUCCACUGUAGAAGGGGAUGAA |
| SEQ ID NO: 335 | WT-REV-16 | UAAUUUCUACUAAGUGUAGAUGCCACUGUAGAAGGGGAUGA |
| SEQ ID NO: 336 | WT-REV-17 | UAAUUUCUACUAAGUGUAGAUGGCCACUGUAGAAGGGGAUG |
| SEQ ID NO: 337 | WT-REV-18 | UAAUUUCUACUAAGUGUAGAUAGGCCACUGUAGAAGGGGAU |
| SEQ ID NO: 338 | WT-REV-19 | UAAUUUCUACUAAGUGUAGAUAAGGCCACUGUAGAAGGGGA |
| SEQ ID NO: 339 | WT-REV-20 | UAAUUUCUACUAAGUGUAGAUUAAGGCCACUGUAGAAGGGG |
| SEQ ID NO: 340 | rs738409-FWD-1 | UAAUUUCUACUAAGUGUAGAUGCCCUUCUACAGUGGCCUUA |
| SEQ ID NO: 341 | rs738409-FWD-2 | UAAUUUCUACUAAGUGUAGAUUGCCCUUCUACAGUGGCCUU |
| SEQ ID NO: 342 | rs738409-FWD-3 | UAAUUUCUACUAAGUGUAGAUAUGCCCUUCUACAGUGGCCU |
| SEQ ID NO: 343 | rs738409-FWD-4 | UAAUUUCUACUAAGUGUAGAUCAUGCCCUUCUACAGUGGCC |
| SEQ ID NO: 344 | rs738409-FWD-5 | UAAUUUCUACUAAGUGUAGAUUCAUGCCCUUCUACAGUGGC |
| SEQ ID NO: 345 | rs738409-FWD-6 | UAAUUUCUACUAAGUGUAGAUUUCAUGCCCUUCUACAGUGG |
| SEQ ID NO: 346 | rs738409-FWD-7 | UAAUUUCUACUAAGUGUAGAUCUUCAUGCCCUUCUACAGUG |
| SEQ ID NO: 347 | rs738409-FWD-8 | UAAUUUCUACUAAGUGUAGAUGCUUCAUGCCCUUCUACAGU |
| SEQ ID NO: 348 | rs738409-FWD-9 | UAAUUUCUACUAAGUGUAGAUUGCUUCAUGCCCUUCUACAG |
| SEQ ID NO: 349 | rs738409-FWD-10 | UAAUUUCUACUAAGUGUAGAUCUGCUUCAUGCCCUUCUACA |
| SEQ ID NO: 350 | rs738409-FWD-11 | UAAUUUCUACUAAGUGUAGAUCCUGCUUCAUGCCCUUCUAC |
| SEQ ID NO: 351 | rs738409-FWD-12 | UAAUUUCUACUAAGUGUAGAUUCCUGCUUCAUGCCCUUCUA |
| SEQ ID NO: 352 | rs738409-FWD-13 | UAAUUUCUACUAAGUGUAGAUUUCCUGCUUCAUGCCCUUCU |
| SEQ ID NO: 353 | rs738409-FWD-14 | UAAUUUCUACUAAGUGUAGAUGUUCCUGCUUCAUGCCCUUC |
| SEQ ID NO: 354 | rs738409-FWD-15 | UAAUUUCUACUAAGUGUAGAUUGUUCCUGCUUCAUGCCCUU |
| SEQ ID NO: 355 | rs738409-FWD-16 | UAAUUUCUACUAAGUGUAGAUAUGUUCCUGCUUCAUGCCCU |

TABLE 26-continued gRNAs for Detection of Target Sequences with Artificially Introduced PAMs

| SEQ ID NO: | Target | gRNA Sequence |
|---|---|---|
| SEQ ID NO: 356 | rs738409-FWD-17 | UAAUUUCUACUAAGUGUAGAUUAUGUUCCUGCUUCAUGCCC |
| SEQ ID NO: 357 | rs738409-FWD-18 | UAAUUUCUACUAAGUGUAGAUGUAUGUUCCUGCUUCAUGCC |
| SEQ ID NO: 358 | rs738409-FWD-19 | UAAUUUCUACUAAGUGUAGAUGGUAUGUUCCUGCUUCAUGC |
| SEQ ID NO: 359 | rs738409-FWD-20 | UAAUUUCUACUAAGUGUAGAUUGGUAUGUUCCUGCUUCAUG |
| SEQ ID NO: 360 | rs738409-REV-1 | UAAUUUCUACUAAGUGUAGAUCAUGAAGCAGGAACAUACCA |
| SEQ ID NO: 361 | rs738409-REV-2 | UAAUUUCUACUAAGUGUAGAUGCAUGAAGCAGGAACAUACC |
| SEQ ID NO: 362 | rs738409-REV-3 | UAAUUUCUACUAAGUGUAGAUGGCAUGAAGCAGGAACAUAC |
| SEQ ID NO: 363 | rs738409-REV-4 | UAAUUUCUACUAAGUGUAGAUGGGCAUGAAGCAGGAACAUA |
| SEQ ID NO: 364 | rs738409-REV-5 | UAAUUUCUACUAAGUGUAGAUAGGGCAUGAAGCAGGAACAU |
| SEQ ID NO: 365 | rs738409-REV-6 | UAAUUUCUACUAAGUGUAGAUAAGGGCAUGAAGCAGGAACA |
| SEQ ID NO: 366 | rs738409-REV-7 | UAAUUUCUACUAAGUGUAGAUGAAGGGCAUGAAGCAGGAAC |
| SEQ ID NO: 367 | rs738409-REV-8 | UAAUUUCUACUAAGUGUAGAUAGAAGGGCAUGAAGCAGGAA |
| SEQ ID NO: 368 | rs738409-REV-9 | UAAUUUCUACUAAGUGUAGAUUAGAAGGGCAUGAAGCAGGA |
| SEQ ID NO: 369 | rs738409-REV-10 | UAAUUUCUACUAAGUGUAGAUGUAGAAGGGCAUGAAGCAGG |
| SEQ ID NO: 370 | rs738409-REV-11 | UAAUUUCUACUAAGUGUAGAUUGUAGAAGGGCAUGAAGCAG |
| SEQ ID NO: 371 | rs738409-REV-12 | UAAUUUCUACUAAGUGUAGAUCUGUAGAAGGGCAUGAAGCA |
| SEQ ID NO: 372 | rs738409-REV-13 | UAAUUUCUACUAAGUGUAGAUACUGUAGAAGGGCAUGAAGC |
| SEQ ID NO: 373 | rs738409-REV-14 | UAAUUUCUACUAAGUGUAGAUCACUGUAGAAGGGCAUGAAG |
| SEQ ID NO: 374 | rs738409-REV-15 | UAAUUUCUACUAAGUGUAGAUCCACUGUAGAAGGGCAUGAA |
| SEQ ID NO: 375 | rs738409-REV-16 | UAAUUUCUACUAAGUGUAGAUGCCACUGUAGAAGGGCAUGA |
| SEQ ID NO: 376 | rs738409-REV-17 | UAAUUUCUACUAAGUGUAGAUGGCCACUGUAGAAGGGCAUG |
| SEQ ID NO: 377 | rs738409-REV-18 | UAAUUUCUACUAAGUGUAGAUAGGCCACUGUAGAAGGGCAU |
| SEQ ID NO: 378 | rs738409-REV-19 | UAAUUUCUACUAAGUGUAGAUAAGGCCACUGUAGAAGGGCA |
| SEQ ID NO: 379 | rs738409-REV-20 | UAAUUUCUACUAAGUGUAGAUUAAGGCCACUGUAGAAGGGC |

In a third assay, sensitivity of the detection assay to single- and double-point mutations was tested. As used in the assay shown in FIG. 78, the PNPLA3 target sequence with two SNP sites was capable of being detected by certain gRNAs. Sensitivity of a programmable nuclease of SEQ ID NO: 11 to SNP mutations was tested individually and in combination. FIG. 78 shows detection of single and double mutations in a target nucleic acid sequence using a programmable nuclease of SEQ ID NO: 11. Target sequences corresponding to SEQ ID NO: 412-SEQ ID NO: 415 were detected. Samples containing a target nucleic acid ("target") with either a wild type nucleic acid sequence (SEQ ID NO: 415, "WT"), a sequence with a mutation at a first SNP (SEQ ID NO: 413, "rs738408"), a sequence with a mutation at a second SNP (SEQ ID NO: 414, "rs738409"), or a sequence with mutations at the first SNP and the second SNP (SEQ ID NO: 412, "rs738409/408") were detected using a gRNA directed to the wild type sequence (SEQ ID NO: 301, "R1287-WT"), a gRNA directed to the sequence with a mutation at a second SNP (SEQ ID NO: 341, "R1327-rs738409"), a gRNA directed to the sequence with a mutation at a first SNP (SEQ ID NO: 421, "R1434-rs738408"), or a gRNA directed to the sequence with mutations at the first SNP and the second SNP (SEQ ID NO: 422, "R1435-rs738409/408"). Detection was measured using fluorescence, and the maximum rate ("Max Rate (AU/min)") was calculated as fluorescence units per minute. The results showed that gRNAs could be designed that were specific to each of the wild type sequence (SEQ ID NO: 415, "WT"), the sequence with a mutation at a first SNP (SEQ ID NO: 413, "rs738408"), the sequence with a mutation at a second SNP (SEQ ID NO: 414, "rs738409"), or the sequence with mutations at both the first SNP and the second SNP (SEQ ID NO: 412, "rs738409/408"). Furthermore, a programmable nuclease of SEQ ID NO: 11 was sensitive to single and double mutations and gRNAs were designed to detect all allele possibilities. NTC shows control experiments without the target nucleic acid.

In a fourth assay, the functionality of gRNAs targeted to specific point mutations in combined pools was tested. The wild type, single-, and double-point mutants tested in the assay shown in FIG. 78 were tested with pooled gRNAs. FIG. 79 shows detection of two PNPLA3 SNPs in a target nucleic acid sequence without a native PAM using a programmable nuclease of SEQ ID NO: 11. Target nucleic acids containing the wild type sequence (SEQ ID NO: 415, "WT"), a sequence with a mutation at a first SNP (SEQ ID NO: 413, "rs738408"), a sequence with a mutation at a second SNP (SEQ ID NO: 414, "rs738409"), or a sequence with mutations at the first SNP allele and the second SNP (SEQ ID NO: 412, "rs738409/408"). A sample without a target sequence (non-target control, "NTC") was used as a negative control. Guide RNAs designed to detect the wild type sequence or the sequence with a mutation at the first SNP (SEQ ID NO: 301 and SEQ ID NO: 421, "WT DETECTR") were pooled to detect the target nucleic acid in each sample type. Guide RNAs designed to detect the sequence with a mutation at the second SNP (SEQ ID NO: 341 and SEQ ID NO: 422, "rs738409 DETECTR") were pooled to detect the target nucleic acid in each sample type. Detection was measured using fluorescence, and the maximum rate ("Max Rate (AU/min)") was calculated as fluorescence units per minute. The results showed that gRNAs could be pooled to selectively detect SNPs of interest and not other nearby genetic variation. A first gRNA pool was able to detect both the wild type sequence (SEQ ID NO: 415, "WT") and the sequence with a mutation at a first SNP (SEQ ID NO: 413, "rs738408"), while a second gRNA pool was able to detect the sequence with a mutation at a second SNP (SEQ ID NO: 414, "rs738409") and the sequence with mutations at both the first SNP and the second SNP (SEQ ID NO: 412, "rs738409/408"). Guide RNA sequences used in each pool are provided in TABLE 27.

The target nucleic acids comprising the PAM site with each of all possible point mutations were detected with using LbCas12a (SEQ ID NO: 1).

FIG. 80 shows detection of single point mutations at different positions along a nucleic acid sequence using LbCas12a (SEQ ID NO: 1). Point mutations to each nucleic acid (A, T, C, or G, "SNP Base (target)") were made along a target nucleic acid sequence at different positions relative to a native PAM. To determine the sensitivity of the detection assay to single point mutations (e.g., a SNP), the target nucleic acid was detected using a gRNA directed to hybridize to the wild type sequence. Black circles label with "WT" indicate nucleotide at each position of the wild type sequence that is reverse complementary to the gRNA sequence. The assay was performed with a HERC2 target sequence (top panel, wild type sequence corresponding to SEQ ID NO: 416) or an ALDH target sequence (bottom panel, wild type sequence corresponding to SEQ ID NO: 417). Upon hybridization of gRNA to the target nucleic acid, SEQ ID NO: 11 is activated and trans cleaves a reporter, releasing a fluorescent detectable label. The HERC2 sequence was detected using a gRNA corresponding to SEQ ID NO: 246 (top plot) and the ALDH sequence was detected using a gRNA corresponding to SEQ ID NO: 425 (bottom plot). Detection of target nucleic acids with SNPs was carried out by measuring fluorescence from the cleaved detectable label, and the maximum rate ("Average Max Rate") was calculated as fluorescence units per minute and averaged between four replicates. Results indicated that LbCas12a was sensitive to point mutations along the entire length of the gRNA target site. The specificity for individual point mutations depended on sequence context of the target nucleic acid.

TABLE 27 gRNAs Pools for Detection of two PNPLA3 SNP Alleles

| SEQ ID NO: | gRNA Pool | gRNA Sequence |
| --- | --- | --- |
| SEQ ID NO: 301 | WT DETECTR gRNAs | UAAUUUCUACUAAGUGUAGAUUCCCCUUCUACAGUGGCCUU |
| SEQ ID NO: 421 | WT DETECTR gRNAs | UAAUUUCUACUAAGUGUAGAUUCCCUUUCUACAGUGGCCUU |
| SEQ ID NO: 341 | Rs738409 DETECTR gRNAs | UAAUUUCUACUAAGUGUAGAUUGCCCUUCUACAGUGGCCUU |
| SEQ ID NO: 422 | Rs738409 DETECTR gRNAs | UAAUUUCUACUAAGUGUAGAUUGCCUUUCUACAGUGGCCUU |

Example 28

LbCas12a SNP Sensitivity Along a Target Sequence

This example describes sensitivity of LbCas12a to SNPs positioned along a target sequence. In a first assay, sensitivity to point mutations in a target sequence with a native PAM site was tested. To determine which positions along a target nucleic acid sequence were most sensitive to single point mutations, all four nucleotide possibilities (A, T, C, or G) at each position were tiled along a target of a target nucleic acid sequence. The assay was performed for two target nucleic acid sequences, a HERC2 target nucleic acid sequence and an ALDH target nucleic acid sequence. Both target nucleic acid sequences comprised a native PAM site.

In a second assay, LbCas12a (SEQ ID NO: 1) was used to detect variants at two SNP sites in a target nucleic acid sequence without a native PAM. The detection assay was run for 90 minutes at 37° C. with either a wild type DNA ("WT"), a target DNA with a mutation at a first SNP ("rs738408"), or a target DNA with a mutation at a second SNP ("rs738409").

FIG. 81 shows detection of two PNPLA3 SNPs in a target nucleic acid sequence without a native "TTTN" PAM sequence using LbCas12a (SEQ ID NO: 1). Target nucleic acids tested contained the wild type sequence (SEQ ID NO: 415, "WT"), a sequence with a mutation at a first SNP (SEQ ID NO: 413, "rs738408"), a sequence with a mutation at a second SNP (SEQ ID NO: 414, "rs738409"), or a sequence with mutations at the first SNP allele and the second SNP (SEQ ID NO: 412, "rs738409/408"). Guide RNAs were designed to detect the wild type sequence ("WT specific") or the sequence with a mutation at the second SNP ("rs738409 specific"). Guide RNAs corresponding to SEQ ID NO: 300-SEQ ID NO: 319 were directed to the wild type (SEQ ID NO: 415, "WT") sequence on the forward strand at position 1-position 20, respectively. gRNAs corresponding to SEQ ID NO: 320-SEQ ID NO: 339 were directed to the wild type ("WT") sequence on the reverse strand at position 1-position 20, respectively. gRNAs corresponding to SEQ ID NO: 340-SEQ ID NO: 359 were directed to the mutant (SEQ ID NO: 414, "rs738409") sequence on the forward strand at position 1-position 20, respectively. gRNAs corresponding to SEQ ID NO: 360-SEQ ID NO: 379 were directed to the mutant ("rs738409") sequence on the reverse strand at position 1-position 20, respectively. Each gRNA was used to detect four different target sequences corresponding to the wild type sequence (SEQ ID NO: 415, "WT"), a sequence with a point mutation at a first site (SEQ ID NO: 413, "rs738408"), a sequence with a point mutation at a second site (SEQ ID NO: 414, "rs738409"), or a sequence with point mutations at both the first site and the second site (SEQ ID NO: 412, "rs738409+rs738408"). Sequences of the gRNAs used in this experiment are provided in TABLE 26.

Detection reactions were carried out using gRNAs designed to target different positions on the target nucleic acid relative to the position of the SNP on either the forward or reverse strand (shown on the x-axis is the position relative to the SNP on either the forward or reverse strand). Upon hybridization of gRNA to the target nucleic acid, LbCas12a was activated and trans cleaved a reporter (SEQ ID NO: 119 with N-terminal/56-FAM/and C-terminal /3IABkFQ/), releasing a fluorescent detectable label. Detection of target nucleic acids with SNPs was carried out by measuring fluorescence from the cleaved detectable label, and the maximum rate ("Max Rate (AU/min)") was calculated as fluorescence units per minute. gRNAs that exhibited specificity for the wild type sequence or the sequence with the mutation at the second SNP are indicated by arrows. The results demonstrated that certain gRNAs were specific for the wild type sequence ("WT") or the sequence with the mutation at the second SNP ("rs738409"), but did not non-specifically detect the sequence with the mutation at the first SNP ("rs738408").

Example 29

CasY3 SNP Sensitivity Along a CYP2C19*2 SNP Target Sequence

This example describes sensitivity of CasY3 to the CYP2C19*2 SNP positioned along a target sequence. The ability for CasY3 to discriminate single point mutations is tested. The SNP sensitivity of CasY3 for the CYP2C19*2 SNP on sequences with and without native TR PAMs is tested. Target nucleic acids having either a wild type sequence ("WT") or a sequence with a single point mutation ("mt") are detected using CasY3. Target DNA is detected at a concentration of 1 nM in the detection assay, which is run for 90 minutes at 37° C. Target nucleic acid sequences with or without a native TR PAM using CasY3 (SEQ ID NO: 282) are detected. Samples comprise a wild type target nucleic acid sequence or a sequence with a mutation at a SNP are detected with gRNAs comprising a crRNA and a scout RNA (sctRNA) designed to target different positions relative on the target nucleic acid relative to the position of the SNP on either the forward strand or the reverse strand. crRNAs are directed to the wild type sequence on the forward strand at position 1-position 18 on a target nucleic acid, respectively. crRNAs corresponding to are directed to the wild type sequence on the reverse strand at position 1-position 18 on a target nucleic acid, respectively. Upon hybridization of gRNA to the target nucleic acid, CasY3 is activated and trans cleaves a reporter, releasing a fluorescent detectable label. Detection of target nucleic acids with SNPs is carried out by measuring fluorescence from the cleaved detectable label. The maximum rate ("Max Rate (AU/min)") is calculated as fluorescence units per minute. gRNAs are identified that are specific for the wild type sequence or the sequence with the mutation at the second SNP.

Example 30

LbuCas13a SNP Sensitivity Along a Target Sequence

This example describes sensitivity of LbuCas13a to SNPs positioned along a target sequence. RNA and ssDNA target nucleic acid sequences were tested. In a first assay, sensitivity to point mutations in an RNA target nucleic acid was tested. To determine which positions along an RNA target nucleic acid sequence were most sensitive to single point mutations, all four nucleotide possibilities (A, T, C, or G) at each position were tiled along a target of a target nucleic acid sequence. The assay was performed for a target RNA sequence from influenza A virus. The RNA target nucleic acid with each of all possible point mutations was detected with using LbuCas13a (SEQ ID NO: 104). The RNA target nucleic acid was detected at 0.25 nM target, and the assay was run for 20 minutes.

FIG. 82 shows detection of single point mutations at different positions along target RNA sequence (SEQ ID NO: 748) using LbuCas13a (SEQ ID NO: 104). Point mutations to each nucleic acid (A, T, C, or G, "SNP Base (target)") were made along a target nucleic acid sequence at different positions relative to a native PAM. To determine the sensitivity of the detection assay to single point mutations (e.g., a SNP), the target nucleic acid was detected using a gRNA directed to hybridize to the wild type sequence. Black circles label with "WT" indicate nucleotide at each position of the wild type sequence that is reverse complementary to the gRNA sequence. Data is not shown for wild type positions (black circles labeled with "WT"). Detection of the wild type sequence is shown in the square marked "WT" at SNP position 1. Detection of a negative control (water) is shown in the square marked "None" at position "None." The targets were detected using a gRNA corresponding to SEQ ID NO: 507. Upon hybridization of gRNA to the target nucleic acid, LbuCas13a was activated and trans cleaved a reporter, releasing a fluorescent detectable label. Detection of target nucleic acids with SNPs was carried out by measuring fluorescence from the cleaved detectable label. Results showed that LbuCas13a was able to differentiate certain single point mutations at some positions along the RNA target sequence. Sites at which LbuCas13a was able to distinguish all four nucleotide positions are indicated by arrows.

In a second assay, sensitivity to point mutations in a ssDNA target nucleic acid was tested. To determine which positions along a ssDNA target nucleic acid sequence were most sensitive to single point mutations, all four nucleotide possibilities (A, T, C, or G) were tiled along a target of a target nucleic acid sequence. The assay was performed for a target ssDNA sequence from influenza A virus. The RNA target nucleic acid with each of all possible point mutations was detected with using LbuCas13a (SEQ ID NO: 104). The RNA target nucleic acid was detected at 2.5 nM target, and the assay was run for 20 minutes at 37° C. FIG. 83 shows detection of single point mutations at different positions along target ssDNA (SEQ ID NO: 749) sequence using LbuCas13a (SEQ ID NO: 104). Point mutations to each nucleic acid (A, T, C, or G, "SNP Base (target)") were made along a target nucleic acid sequence with a wild type sequence corresponding to SEQ ID NO: 407 (TC-TACGCTGCAGTCCTCGCT) at different positions relative to a native PAM. To determine the sensitivity of the detection assay to single point mutations (e.g., a SNP), the target nucleic acid was detected using a gRNA directed to the wild type sequence. Black circles label with "WT" indicate the nucleotide at each position of the wild type sequence that is reverse complementary to the gRNA sequence. Data is not shown for wild type positions (black circles labeled with "WT"). Detection of the wild type sequence is shown in the square marked "WT" at SNP position 1. Detection of a negative control (water) is shown in the square marked "None" at position "None." The targets were detected using a gRNA corresponding to SEQ ID NO: 507. Upon hybridization of gRNAs to the target nucleic acid, LbuCas31a was activated and trans cleaved a reporter, releasing a fluorescent detectable label. Detection of target nucleic acids with SNPs was carried out by measuring fluorescence from the cleaved detectable label. Results showed that LbuCas13a was able to differentiate certain single point mutations at some positions along the ssDNA target sequence. Sites at which LbuCas13a was able to distinguish all four nucleotide mutations are indicated by black arrows. Sites at which LbuCas13a was able to distinguish at least one nucleotide mutation are indicated by gray arrows.

Example 31

Detection of a Nucleic Acid Amplified with dUTPs Using DETECTR

This example describes detection of a nucleic acid that had been amplified with dUTPs using a DETECTR reaction. Two target nucleic acid sequences, ALDH2 wild type sequence and ALDH2 with a single point mutation at T790M ("T790M"), were amplified in a PCR reaction performed with dUTP nucleotide bases in place of dTTP nucleotide bases. Each PCR amplification reaction included 1 µM forward primer, 1 µM reverse primer, Taq polymerase (in Taq master mix), UDG enzyme, and a template sequence with either the ALDH2 wild type sequence or ALDH2 T790M mutant sequence. The UDG enzyme was heat-activated at 50° C. prior to amplification to degrade nucleic acid contaminants containing dU bases. The UDG enzyme was subsequently inactivated at 90° C. before initiating PCR amplification of the target nucleic acid. Amplification of the target sequence was verified by gel electrophoresis. The ALDH2 wild type sequence was successfully amplified. In an alternate assay configuration, a thermolabile UDG enzyme was used in place of the UDG enzyme. The thermolabile UDG enzyme was activated at 25° C. for 10 minutes prior to amplification to degrade nucleic acid contaminants containing dU bases. The thermolabile UDG enzyme was subsequently inactivated at a temperature of at least 50° C. before initiating PCR amplification of the target nucleic acid.

The amplified ALDH2 wild type sequence with dUTPs was detected using an LbCas12a detection assay. The ALDH2 wild type sequence was detected with either a gRNA directed to hybridize to the wild type sequence ("ALDH2 (WT SNP)") or a gRNA directed to hybridize to the T790M mutant sequence ("ALDH2 (Mutant SNP)"). Each detection reaction included 1.25 gRNA, 200 nM LbCas12a (SEQ ID NO: 1), 100 nM ssDNA-FQ reporter substrate, and the target sequence containing dUTPs.

FIG. 71A-FIG. 71B show the detection of ALDH2 WT allele from human genomic DNA (SEQ ID NO: 417) with dU-containing amplicons with Cas12. The ALDH2 gene was amplified from human saliva containing the WT allele using Taq master mix containing dUTP in place of dTTP, such that all T nucleotides with the annotated ALDH2 target sequence shown in FIG. 71A have been replaced by U nucleotides. The amplicon was added directly to a Cas12 DETECTR assay. Cas12 guide RNAs targeting the ALDH2 WT allele detected only the cognate WT sequence and not the mutant allele, demonstrating that Cas12 is capable of SNP detection with dU-containing targets. FIG. 71B shows a DETECTR reaction of an ALDH2 target nucleic acid sequence amplified with dUTPs using LbCas12a (SEQ ID NO: 1). Fluorescence was measured over time in the presence of the wild type nucleic acid sequence ("WT SNP", top most line), a sequence with a point mutation ("Mutant SNP", middle line), or a negative control without the target nucleic acid sequence (bottom line). Samples were detected with gRNAs directed to hybridize to the wild type sequence. Results showed that the LbCas12a detection assay detected target nucleic acid sequences amplified with dUTPs. The detection assay was specific for the gRNA directed to the wild type sequence and did not non-specifically detect the wild type sequence with the gRNA directed to hybridize to the T790M mutant sequence. Primers used in this assay are provided in TABLE 22.

To verify that the amplified product detected in the LbCas12a detection reaction contained dUTPs, the target nucleic acid was contacted with UDG enzyme which degrades nucleic acid sequences with dUTPs. The amplified target sequence was successfully degraded by UDG. Degradation of the target sequence by UDG was verified by gel electrophoresis.

Example 32

In Vitro Transcription of a Nucleic Acid Reverse Transcribed and Amplified with dUTPs This example describes in vitro transcription of a nucleic acid that had been reverse transcribed and amplified with dUTPs. Target RNA nucleic acid sequences were amplified using primers directed to sites with the prostate cancer biomarkers PCA3, PSA, and T2ERG. The target RNA sequences were reverse transcribed using a reverse transcriptase enzyme. The reverse transcribed DNA was then amplified using PCR with dUTP nucleic acid bases in place of dTTP nucleic acid bases. Amplification was verified by gel electrophoresis. The amplified DNA was then transcribed into RNA using an in vitro transcription reaction with a T7 RNA polymerase.

Example 33

Detection of *Chlamydia* Using PCR, IVT, and DETECTR

This example describes detection of chlamydia nucleic acids in a sample using PCR, in vitro transcription (IVT) and DETECTR. Detection sensitivity for chlamydia nucleic acids was improved by amplifying a chlamydia target nucleic acid sequence and reverse transcribing the amplified sequence by in vitro transcription. The target sequence was PCR amplified using dUTPs in place of dTTPs, as described in EXAMPLE 31. The amplified PCR product was used as a template for the in vitro transcription reaction. In vitro transcription reaction was performed with a T7 RNA polymerase. The amplified and transcribed nucleic acid sequence was detected using an LbuCas13a detection assay. The detection assay was performed with 40 nM gRNA and 40 nM LbuCas13a (SEQ ID NO: 104). The reaction was run for 30 minutes at 37° C. Following incubation, FAM-U5 reporter and RNase inhibitor were added to the reaction mixture and fluorescence was measured.

FIG. 84 shows detection of a *Chlamydia trachomatis* target nucleic acid sequence with LbuCas13a (SEQ ID NO: 104) following polymerase chain reaction (PCR) amplification and in vitro transcription (IVT) of samples that were either positive or negative for *Chlamydia*. Targets were detected with either a gRNA targeted to *Chlamydia* 5S rRNA (SEQ ID NO: 418), a gRNA targeted to *Chlamydia* 16S rRNA (SEQ ID NO: 419), or an off-target gRNA (SEQ ID NO: 420). Fluorescence was measured over time. An increase in fluorescence indicated detection of the target nucleic acid sequence. Thirty-one samples either positive or negative for *Chlamydia* or a negative control with no target nucleic acid were detected. Fluorescence over time detected in each sample is shown in individual plots. The top left plot shows the negative control. Each sample was detected with each of three different gRNAs (SEQ ID NO: 418, "CT001-33;" SEQ ID NO: 419, "SSU-1368;" or SEQ ID NO: 410, "C"), as shown by individual traces in each plot. Sequences for the gRNAs are provided in TABLE 28.

corresponding to SEQ ID NO: 11, SEQ ID NO: 3, and SEQ ID NO: 571-SEQ ID NO: 589 were tested for trans cleavage activity as well as sensitivity and specificity for target sequences.

In a first assay, each Cas12 variant was tested for sensitivity and ability to detect a target nucleic acid sequence with different PAM sequences. DETECTR trans cleavage assays were performed in the presence of activity buffer (5 mM MgCl$_2$, 20 mM, Tris pH 7.5, 120 mM NaCl, and 1% glycerol). Different dsDNA target nucleic acids with different PAM sequences were detected at a final concentration of 100 nM. ssDNA reporters were present in each reaction at a concentration of 50 nM. Target dsDNA was obtained by annealing complementary ssDNA primers at a ratio of 2:1 of non-target strand to target strand in hybridization buffer (50 mM NaCl, 1 mM Tris pH 8.0, 0.1 mM EDTA), to ensure double-stranded DNA is being detected instead of single-stranded DNA. Pre-crRNA was ordered from Synthego. The protein of interest and the guide RNA were added to each tube and incubated for 20 minutes at 37° C. Each reaction contained 16 µL of the incubated mastermix. FIG. 85 shows trans cleavage rates of different Cas12 variants upon complex formation with a gRNA and a target sequence comprising different PAM sequences. PAM sequences and the sequences of the target and non-target strands are provided in TABLE 29. Individual plots show trans cleavage rates for each Cas12 variant, and each part illustrates the cleavage rate for target sequences comprising different PAM sequences. The pre-crRNA used in each reaction was GUUUCAAAGAUUAAAUAAUUUCUACUAAGUGUA-GAUUCCUGCAGCAGAAAAUCA AAGACAAUGAAUAUUUCGGCGC (SEQ ID NO: 380). Trans cleavage activity was measured as a function of cleavage rate. Variants including SEQ ID NO: 11, SEQ ID

TABLE 28 gRNAs for Detection of a *Chlamhydia* Target Nucleic Acid

| SEQ ID NO: | gRNA Name | gRNA Sequence |
| --- | --- | --- |
| SEQ ID NO: 418 | CT001-33 | GGCCACCCCAAAAAUGAAGGGGACUAAAACACUUCUGAG UUCGGAAUGGUG |
| SEQ ID NO: 419 | SSU-1368 | GGCCACCCCAAAAAUGAAGGGGACUAAAACAACGUAUUC ACGGCGUUAUGG |
| SEQ ID NO: 420 | R003 | GGCCACCCCAAAAAUGAAGGGGACUAAAACAGUGAUAAG UGGAAUGCCAUG |

FIG. 85 shows heatmaps of the fluorescence detected in FIG. 84 (right). Panels on the right indicate the maximum fluorescent rate detected with either a gRNA targeting a *Chlamydia* 16S RNA sequence (SEQ ID NO: 419, "16S gRNA"), a gRNA targeting a *Chlamydia* 5S RNA sequence (SEQ ID NO: 418, "5S gRNA"), or a gRNA not directed to a *Chlamydia* target sequence (SEQ ID NO: 420, "off-target gRNA"). Shaded boxes in the left column ("Ct") indicate that the sample was positive for *Chlamydia*. Results showed that SSU-1368 (SEQ ID NO: 419) is more specific for the chlamydia target sequence than CT001-33 (SEQ ID NO: 418).

Example 34

Identification of Cas12 Variants with Trans Cleavage Activity

This example describes the identification of Cas12 variants with trans cleavage activity. Different Cas12 variants NO: 575, SEQ ID NO: 581, SEQ ID NO: 587, and SEQ ID NO: 3 exhibit transcleavage activity in the presence of a variety of PAM sequences.

In a second assay, each Cas12 variant was tested for sensitivity of trans cleavage activity to base pair mismatches between the target nucleic acid and the gRNA. To measure the tolerance of each Cas12 variant to mismatches, single or double mismatches were introduced in the first ("1 MM"), fifth ("5 MM"), tenth ("10 MM"), fifteenth ("15 MM"), and twentieth ("20 MM") nucleotide position after the PAM (TTTA (SEQ ID NO: 384)). Sequences of the mismatched strands are listed in TABLE 29. DETECTR trans cleavage assays were performed in the presence of activity buffer (5 mM MgCl$_2$, 20 mM, Tris pH 7.5). Different dsDNA target nucleic acids with different base pair mismatched sequences were detected at a final concentration of 100 nM. ssDNA reporters were present in each reaction at a concentration of 50 nM. Target dsDNA was obtained by annealing complementary ssDNA primers at a ratio of 2:1 of non-target strand to target strand in hybridization buffer (50 mM NaCl, 1 mM Tris pH 8.0, 0.1 mM EDTA), to ensure double-stranded DNA is being detected instead of single-stranded DNA. Pre-crRNA was ordered from Synthego. The protein of interest and the guide RNA were added to each tube and incubated for 20 minutes at 37° C. Each reaction contained 16 μL of the incubated mastermix. FIG. 87A shows a schematic of a Cas protein, gRNA, and target sequence complex comprising either a single base pair mismatch (top) or a double base pair mismatch (bottom) between the gRNA and the target sequence. FIG. 87B shows trans cleavage activity of different Cas12 variants upon complex formation with a gRNA and a target sequence having either a single base pair mismatch (top) or a double base pair mismatch (bottom). The gRNA used in each reaction was GUUU-CAAAGAUUAAAUAAUUUCUACUAAGUGUA-GAUUCCUGCAGCAGAAAAUCA AAGACAAUGAAUAUUUCGGCGC (SEQ ID NO: 380). Trans cleavage activity was measured as a function of fluorescence. Most Cas12 variants were able to tolerate both single and double mismatches starting from 15th and 20th position with respect to the PAM sequence, but trans cleavage rate decreased when a mismatch was introduced within the seed region (nucleotides at positions 1-10 of the spacer region at the PAM-proximal end). PAM sequences and the sequences of the target and non-target strands are provided in TABLE 29.

TABLE 29

Substrate nucleic acid sequences for the target and non-target strands

| Substrates | Non Target Strand | Target Strand |
|---|---|---|
| TTTT (SEQ ID NO: 381) | GCCCGCGGGATTTTTTCCTGCAGCAGAAAATCAAAGACAATGAATATTTCGGCGC (SEQ ID NO: 603) | GCGCCGAAATATTCATTGTCTTTGATTTTCTGCTGCAGGAAAAAATCCCGCGGGC (SEQ ID NO: 604) |
| TTTG (SEQ ID NO: 382) | GCCCGCGGGATTTTGTCCTGCAGCAGAAAATCAAAGACAATGAATATTTCGGCGC (SEQ ID NO: 605) | GCGCCGAAATATTCATTGTCTTTGATTTTCTGCTGCAGGACAAAATCCCGCGGGC (SEQ ID NO: 606) |
| TTTC (SEQ ID NO: 383) | GCCCGCGGGATTTTCTCCTGCAGCAGAAAATCAAAGACAATGAATATTTCGGCGC (SEQ ID NO: 607) | GCGCCGAAATATTCATTGTCTTTGATTTTCTGCTGCAGGAGAAAATCCCGCGGGC (SEQ ID NO: 608) |
| TTTA (SEQ ID NO: 384) | GCCCGCGGGATTTTATCCTGCAGCAGAAAATCAAAGACAATGAATATTTCGGCGC (SEQ ID NO: 609) | GCGCCGAAATATTCATTGTCTTTGATTTTCTGCTGCAGGATAAAATCCCGCGGGC (SEQ ID NO: 610) |
| TTGA (SEQ ID NO: 385) | GCCCGCGGGATTTGATCCTGCAGCAGAAAATCAAAGACAATGAATATTTCGGCGC (SEQ ID NO: 611) | GCGCCGAAATATTCATTGTCTTTGATTTTCTGCTGCAGGATCAAATCCCGCGGGC (SEQ ID NO: 612) |
| TTCA (SEQ ID NO: 386) | GCCCGCGGGATTTCATCCTGCAGCAGAAAATCAAAGACAATGAATATTTCGGCGC (SEQ ID NO: 613) | GCGCCGAAATATTCATTGTCTTTGATTTTCTGCTGCAGGATGAAATCCCGCGGGC (SEQ ID NO: 614) |
| TTAA (SEQ ID NO: 387) | GCCCGCGGGATTTAATCCTGCAGCAGAAAATCAAAGACAATGAATATTTCGGCGC (SEQ ID NO: 615) | GCGCCGAAATATTCATTGTCTTTGATTTTCTGCTGCAGGATTAAATCCCGCGGGC (SEQ ID NO: 616) |
| TGTA (SEQ ID NO: 388) | GCCCGCGGGATTGTATCCTGCAGCAGAAAATCAAAGACAATGAATATTTCGGCGC (SEQ ID NO: 617) | GCGCCGAAATATTCATTGTCTTTGATTTTCTGCTGCAGGATACAATCCCGCGGGC (SEQ ID NO: 618) |
| TCTA (SEQ ID NO: 389) | GCCCGCGGGATTCTATCCTGCAGCAGAAAATCAAAGACAATGAATATTTCGGCGC (SEQ ID NO: 619) | GCGCCGAAATATTCATTGTCTTTGATTTTCTGCTGCAGGATAGAATCCCGCGGGC (SEQ ID NO: 620) |
| TATA (SEQ ID NO: 390) | GCCCGCGGGATTATATCCTGCAGCAGAAAATCAAAGACAATGAATATTTCGGCGC (SEQ ID NO: 621) | GCGCCGAAATATTCATTGTCTTTGATTTTCTGCTGCAGGATATAATCCCGCGGGC (SEQ ID NO: 622) |
| GTTA (SEQ ID NO: 391) | GCCCGCGGGATGTTATCCTGCAGCAGAAAATCAAAGACAATGAATATTTCGGCGC (SEQ ID NO: 623) | GCGCCGAAATATTCATTGTCTTTGATTTTCTGCTGCAGGATAACATCCCGCGGGC (SEQ ID NO: 624) |
| CTTA (SEQ ID NO: 392) | GCCCGCGGGATCTTATCCTGCAGCAGAAAATCAAAGACAATGAATATTTCGGCGC (SEQ ID NO: 625) | GCGCCGAAATATTCATTGTCTTTGATTTTCTGCTGCAGGATAAGATCCCGCGGGC (SEQ ID NO: 626) |
| ATTA (SEQ ID NO: 393) | GCCCGCGGGATATTATCCTGCAGCAGAAAATCAAAGACAATGAATATTTCGGCGC (SEQ ID NO: 627) | GCGCCGAAATATTCATTGTCTTTGATTTTCTGCTGCAGGATAATATCCCGCGGGC (SEQ ID NO: 628) |
| 1MM | GCCCGCGGGATTTTACCCTGCAGCAGAAAATCAAAGACAATGAATATTTCGGCGC (SEQ ID NO: 629) | GCGCCGAAATATTCATTGTCTTTGATTTTCTGCTGCAGGGTAAAATCCCGCGGGC (SEQ ID NO: 630) |

TABLE 29-continued

Substrate nucleic acid sequences for the target and non-target strands

| Substrates | Non Target Strand | Target Strand |
|---|---|---|
| 5MM | GCCCGCGGGATTTTATCCTACAGCA GAAAATCAAAGACAATGAATATTTC GGCGC (SEQ ID NO: 631) | GCGCCGAAATATTCATTGTCTTTG ATTTTCTGCTGTAGGATAAAATCC CGCGGGC (SEQ ID NO: 632) |
| 10MM | GCCCGCGGGATTTTATCCTGCAGCG GAAAATCAAAGACAATGAATATTTC GGCGC (SEQ ID NO: 633) | GCGCCGAAATATTCATTGTCTTTG ATTTTCCGCTGCAGGATAAAATCC CGCGGGC (SEQ ID NO: 634) |
| 15MM | GCCCGCGGGATTTTATCCTGCAGCA GAAAGTCAAAGACAATGAATATTTC GGCGC (SEQ ID NO: 635) | GCGCCGAAATATTCATTGTCTTTG ACTTTCTGCTGCAGGATAAAATCC CGCGGGC (SEQ ID NO: 636) |
| 20MM | GCCCGCGGGATTTTATCCTGCAGCA GAAAATCAAAGACAATGAATATTTC GGCGC (SEQ ID NO: 609) | GCGCCGAAATATTCATTGTCTTTG ATTTTCTGCTGCAGGATAAAATCC CGCGGGC (SEQ ID NO: 610) |
| 1-2MM | GCCCGCGGGATTTTACTCTGCAGCA GAAAATCAAAGACAATGAATATTTC GGCGC (SEQ ID NO: 637) | GCGCCGAAATATTCATTGTCTTTG ATTTTCTGCTGCAGAGTAAAATCC CGCGGGC (SEQ ID NO: 638) |
| 3-4MM | GCCCGCGGGATTTTATCTCGCAGCA GAAAATCAAAGACAATGAATATTTC GGCGC (SEQ ID NO: 639) | GCGCCGAAATATTCATTGTCTTTG ATTTTCTGCTGCGAGATAAAATCC CGCGGGC (SEQ ID NO: 640) |
| 5-6MM | GCCCGCGGGATTTTATCCTATAGCA GAAAATCAAAGACAATGAATATTTC GGCGC (SEQ ID NO: 641) | GCGCCGAAATATTCATTGTCTTTG ATTTTCTGCTATAGGATAAAATCC CGCGGGC (SEQ ID NO: 642) |
| 7-8MM | GCCCGCGGGATTTTATCCTGCGACA GAAAATCAAAGACAATGAATATTTC GGCGC (SEQ ID NO: 643) | GCGCCGAAATATTCATTGTCTTTG ATTTTCTGTCGCAGGATAAAATCC CGCGGGC (SEQ ID NO: 644) |
| 9-10MM | GCCCGCGGGATTTTATCCTGCAGTG GAAAATCAAAGACAATGAATATTTC GGCGC (SEQ ID NO: 645) | GCGCCGAAATATTCATTGTCTTTG ATTTTCCACTGCAGGATAAAATCC CGCGGGC (SEQ ID NO: 646) |
| 11-12MM | GCCCGCGGGATTTTATCCTGCAGCA AGAAATCAAAGACAATGAATATTTC GGCGC (SEQ ID NO: 647) | GCGCCGAAATATTCATTGTCTTTG ATTTCTTGCTGCAGGATAAAATCC CGCGGGC (SEQ ID NO: 648) |
| 13-14MM | GCCCGCGGGATTTTATCCTGCAGCA GAGGATCAAAGACAATGAATATTTC GGCGC (SEQ ID NO: 649) | GCGCCGAAATATTCATTGTCTTTG ATCCTCTGCTGCAGGATAAAATCC CGCGGGC (SEQ ID NO: 650) |
| 15-16MM | GCCCGCGGGATTTTATCCTGCAGCA GAAAGCCAAAGACAATGAATATTTC GGCGC (SEQ ID NO: 651) | GCGCCGAAATATTCATTGTCTTTG GCTTTCTGCTGCAGGATAAAATCC CGCGGGC (SEQ ID NO: 652) |
| 17-18MM | GCCCGCGGGATTTTATCCTGCAGCA GAAAATTGAAGACAATGAATATTTC GGCGC (SEQ ID NO: 653) | GCGCCGAAATATTCATTGTCTTCA ATTTTCTGCTGCAGGATAAAATCC CGCGGGC (SEQ ID NO: 654) |
| 19-20MM | GCCCGCGGGATTTTATCCTGCAGCA GAAAATCAGGGACAATGAATATTTC GGCGC (SEQ ID NO: 655) | GCGCCGAAATATTCATTGTCCCTG ATTTTCTGCTGCAGGATAAAATCC CGCGGGC (SEQ ID NO: 656) |
| 21-22MM | GCCCGCGGGATTTTATCCTGCAGCA GAAAATCAAAGCAATGAATATTTC GGCGC (SEQ ID NO: 657) | GCGCCGAAATATTCATTGCTTTTG ATTTTCTGCTGCAGGATAAAATCC CGCGGGC (SEQ ID NO: 658) |
| dsDNA off | GGCCAGTTTCATTTGAGCATTAAAT GTCAAGTTCTGCACGCTATCATCAT CAGG (SEQ ID NO: 659) | CCTGATGATGATAGCGTGCAGAA CTTGACATTTAATGCTCAAATGAA ACTGGCC (SEQ ID NO: 660) |
| ssDNA off | GCCCGCGGGATTTTCTCCTGCAGCA GAAAATCAAAGACAATGAATATTTC GGCGC (SEQ ID NO: 607) | |
| ssDNA on | | GCGCCGAAATATTCATTGTCTTTG ATTTTCTGCTGCAGGAGAAAATCC CGCGGGC (SEQ ID NO: 608) |

In a third assay, each Cas12 variant was tested for sensitivity of trans cleavage activity to salt concentration. DETECTR trans cleavage assays were performed in the presence of activity buffer (5 mM MgCl$_2$, 20 mM, Tris pH 7.5, 120 mM NaCl, and 1% glycerol). dsDNA target nucleic acid was detected at a final concentration of 100 nM. ssDNA reporters were present in each reaction at a concentration of 50 nM. Target dsDNA was obtained by annealing complementary ssDNA primers at a ratio of 2:1 of non-target strand to target strand in hybridization buffer (50 mM NaCl, 1 mM Tris pH 8.0, 0.1 mM EDTA), to ensure double-stranded DNA is being detected instead of single-stranded DNA. Pre-crRNA was ordered from Synthego. The protein of interest and the guide RNA were added to each tube and incubated for 20 minutes at 37° C. Each reaction contained 16 µL of the incubated mastermix. FIG. 88 shows trans cleavage activity of different Cas12 variants at different concentrations of NaCl. Most Cas12 variants showed increased trans cleavage activity at low salt concentrations. The gRNA used in each reaction was GUUU-CAAAGAUUAAAUAAUUUCUACUAAGUGUA-GAUUCCUGCAGCAGAAAAUCA AAGACAAUGAAUAUUUCGGCGC (SEQ ID NO: 380). Trans cleavage activity was measured as a function of fluorescence.

Example 35

Identification of Cas12 Variants with Pre-crRNA Processing Activity

This example describes the identification of Cas12 variants with pre-crRNA processing activity. Each Cas12 variant was tested for pre-crRNA processing activity. Processing of pre-crRNA was performed in the presence of activity buffer (5 mM MgCl$_2$, 20 mM, Tris pH 7.5). Pre-crRNA cleavage assays were performed at 37° C. with 4-fold molar excess of the Cas12 variant relative to synthesized crRNA (final concentrations of 100 nM and 50 nM, respectively). Unless otherwise indicated, the reaction was quenched after 1h with 2×RNA loading dye. Following quenching, reactions were denatured at 95° C. for 5 minutes before resolving by 15% denaturing PAGE in 0.5×TBE buffer. FIG. 89 shows urea PAGE gels of pre-crRNA processing activity of different Cas12 variants in the presence ("+") or absence ("−") of a Cas protein. Bands shown are RNA bands. Pre-crRNA processing activity was observed for most Cas12 variants, with different Cas12 variants processing at different rates.

Example 36

Trans Cleavage Activity of Cas12 Variants in the Presence of crRNAs for Native Cas Proteins This example describes trans cleavage activity of Cas12 variants in the presence of crRNAs for native Cas proteins. Each Cas12 variant was tested for orthogonality of the corresponding crRNA to native Cas12 proteins. Each Cas12 variant was incubated with different synthetic Synthego pre-crRNAs and trans cleavage activity was measured. Each pre-crRNA differed in the repeat sequence. The repeat sequence in each crRNA was based on the repeat sequence found in each CRISPR locus of Cas12 proteins. Cas12 variants showed different trans cleavage activity when paired with different pre-crRNAs from different native Cas12 proteins. DETECTR trans cleavage assays were performed in the presence of activity buffer (5 mM MgCl$_2$, 20 mM, Tris pH 7.5). dsDNA target nucleic acid was detected at a final concentration of 100 nM. ssDNA reporters were present in each reaction at a concentration of 50 nM. Target dsDNA was obtained by annealing complementary ssDNA primers at a ratio of 2:1 of non-target strand to target strand in hybridization buffer (50 mM NaCl, 1 mM Tris pH 8.0, 0.1 mM EDTA), to ensure double-stranded DNA is being detected instead of single-stranded DNA. Pre-crRNA was ordered from Synthego. The protein of interest and the guide RNA were added to each tube and incubated for 20 minutes at 37° C. Each reaction contained 16 µL of the incubated mastermix. FIG. 90 shows trans cleavage activity of different Cas12 variants in the presence of different crRNAs based on the native crRNAs found in the CRISPR locus for native Cas12 proteins. Trans cleavage activity was measured using fluorescence. Using crRNAs with different variants showed different transcleavage activity, indicating that some Cas12 variants are more promiscuous with respect to crRNA than others. Pre-crRNA sequences are provided in TABLE 30. Sequence alignments of the repeat regions of different Cas12 variants aligned to the repeat sequence of LbCas12a (SEQ ID NO: 1) are shown in FIG. 92. Repeat sequences of the Cas12 variants correspond to SEQ ID NO: 508-SEQ ID NO: 520 and SEQ ID NO: 522-SEQ ID NO: 536. The repeat sequence of LbCas12a corresponds to SEQ ID NO: 521. The target sequence is set forth in SEQ ID NO: 610.

TABLE 30

Cas12 Ortholog Pre-crRNA Sequences

| Cas12 Ortholog SEQ ID NO | Repeat Sequence | Spacer Sequence | Pre-crRNA Sequence |
| --- | --- | --- | --- |
| SEQ ID NO: 571 | GUCUAAACCUCAAUGAAA AUUUCUACUGUU (SEQ ID NO: 508) | UCCUGCAGCAGAAAAUCA AAGACA (SEQ ID NO: 539) | GUCUAAACCUCAAUGAAAAUUU CUACUGUUUCCUGCAGCAGAAA AUCAAGACA (SEQ ID NO: 540) |
| SEQ ID NO: 572 | CCUAAUAAUUUCUACUGU UGUAGAU (SEQ ID NO: 509) | UCCUGCAGCAGAAAAUCA AAGACA (SEQ ID NO: 539) | CCUAAUAAUUUCUACUGUUGUA GAUUCCUGCAGCAGAAAAUCAA AGACA (SEQ ID NO: 541) |
| SEQ ID NO: 573 | CUCGAAUACCUAUAUUAA AUUUCUACUUUUGUAGAU (SEQ ID NO: 510) | UCCUGCAGCAGAAAAUCA AAGACA (SEQ ID NO: 539) | CUCGAAUACCUAUAUUAAAUUU CUACUUUUGUAGAUUCCUGCAG CAGAAAAUCAAAGACA (SEQ ID NO: 542) |

TABLE 30-continued

Cas12 Ortholog Pre-crRNA Sequences

| Cas12 Ortholog SEQ ID NO | Repeat Sequence | Spacer Sequence | Pre-crRNA Sequence |
|---|---|---|---|
| SEQ ID NO: 575 | GUUUAAUAAACACUUAUA AUUUCUACUGUUGUAGAU (SEQ ID NO: 511) | UCCUGCAGCAGAAAAUCA AAGACA (SEQ ID NO: 539) | GUUUAAUAAACACUUAUAAUUU CUACUGUUGUAGAUUCCUGCAG CAGAAAAUCAAAGACA (SEQ ID NO: 543) |
| SEQ ID NO: 11 | GUUUGGUACCUUUAUUAA UUUCUACUAAGUGUAGAU (SEQ ID NO: 512) | UCCUGCAGCAGAAAAUCA AAGACA (SEQ ID NO: 539) | GUUUGGUACCUUUAUUAAUUUC UACUAAGUGUAGAUUCCUGCAG CAGAAAAUCAAAGACA (SEQ ID NO: 544) |
| SEQ ID NO: 579 | GUUGAGUAACCAUAAGAA AAUUUCUACUGUGUAGAU (SEQ ID NO: 513) | UCCUGCAGCAGAAAAUCA AAGACA (SEQ ID NO: 539) | GUUGAGUAACCAUAAGAAAAUU UCUACUGUGUAGAUUCCUGCAG CAGAAAAUCAAAGACA (SEQ ID NO: 545) |
| SEQ ID NO: 580 | GUUUAAUAAGUAAUAAAU GUCUACUGUAGUGUAGAU (SEQ ID NO: 514) | UCCUGCAGCAGAAAAUCA AAGACA (SEQ ID NO: 539) | GUUUAAUAAGUAAUAAAUGUCU ACUGUAGUGUAGAUUCCUGCAG CAGAAAAUCAAAGACA (SEQ ID NO: 546) |
| SEQ ID NO: 581 | AGUUAAAUAAUAAGAAAG AAUUUCUACUAGUGUAGA U (SEQ ID NO: 515) | UCCUGCAGCAGAAAAUCA AAGACA (SEQ ID NO: 539) | AGUUAAAUAAUAAGAAAGAAUU UCUACUAGUGUAGAUUCCUGCA GCAGAAAAUCAAAGACA (SEQ ID NO: 547) |
| SEQ ID NO: 582 | GUUAAGUAAUAUAAAAGA AUUUCUACUAUUGUAGAU (SEQ ID NO: 516) | UCCUGCAGCAGAAAAUCA AAGACA (SEQ ID NO: 539) | GUUAAGUAAUAUAAAAGAAUUU CUACUAUUGUAGAUUCCUGCAG CAGAAAAUCAAAGACA (SEQ ID NO: 548) |
| SEQ ID NO: 583 | GUUUGACCUACUAAUUAA AUUUCUACUGUUGUAGAU (SEQ ID NO: 517) | UCCUGCAGCAGAAAAUCA AAGACA (SEQ ID NO: 539) | GUUUGACCUACUAAUUAAAUUU CUACUGUUGUAGAUUCCUGCAG CAGAAAAUCAAAGACA (SEQ ID NO: 549) |
| SEQ ID NO: 584 and SEQ ID NO: 588 | GGCUAAAAGUAAUAAACA AUUUCUACUUUCGUAGAU (SEQ ID NO: 518) | UCCUGCAGCAGAAAAUCA AAGACA (SEQ ID NO: 539) | GGCUAAAAGUAAUAAACAAUUU CUACUUUCGUAGAUUCCUGCAG CAGAAAAUCAAAGACA (SEQ ID NO: 550) |
| SEQ ID NO: 587 | GUCAAAUAGUAACUAACA AUUUCUACUUCGGUAGAU (SEQ ID NO: 519) | UCCUGCAGCAGAAAAUCA AAGACA (SEQ ID NO: 539) | GUCAAAUAGUAACUAACAAUUU CUACUUCGGUAGAUUCCUGCAG CAGAAAAUCAAAGACA (SEQ ID NO: 551) |
| SEQ ID NO: 589 | AUCUACACAAAGUAGAGA UUCGAAUGAGUUUUGAC (SEQ ID NO: 520) | UCCUGCAGCAGAAAAUCA AGACA (SEQ ID NO: 539) | AUCUACACAAAGUAGAGAUUCG AAUGAGUUUUGACUCCUGCAGC AGAAAAUCAAAGACA (SEQ ID NO: 552) |
| LbCas12a (SEQ ID NO: 1) | GUUUCAAAGAUUAAAUAA UUUCUACUAAGUGUAGAU (SEQ ID NO: 521) | UCCUGCAGCAGAAAAUCA AAGACA (SEQ ID NO: 539) | GUUUCAAAGAUUAAAUAAUUUC UACUAAGUGUAGAUUCCUGCAG CAGAAAAUCAAAGACA (SEQ ID NO: 553) |
| SEQ ID NO: 3 | GUCUAAGAACUUUAAAUA AUUUCUACUGUUGUAGAU (SEQ ID NO: 522) | UCCUGCAGCAGAAAAUCA AAGACA (SEQ ID NO: 539) | GUCUAAGAACUUUAAAUAAUUU CUACUGUUGUAGAUUCCUGCAG CAGAAAAUCAAAGACA (SEQ ID NO: 554) |
| SEQ ID NO: 590 | AUUUGAAAGCAUCUUUUA AUUUCUACUAUUGUAGAU (SEQ ID NO: 523) | UCCUGCAGCAGAAAAUCA AAGACA (SEQ ID NO: 539) | AUUUGAAAGCAUCUUUUAAUUU CUACUAUUGUAGAUUCCUGCAG CAGAAAAUCAAAGACA (SEQ ID NO: 555) |
| SEQ ID NO: 591 | CUCUAAUAAGAGAUAUGA AUUUCUACUGUUGUAGAU (SEQ ID NO: 524) | UCCUGCAGCAGAAAAUCA AAGACA (SEQ ID NO: 539) | CUCUAAUAAGAGAUAUGAAUUU CUACUGUUGUAGAUUCCUGCAG CAGAAAAUCAAAGACA (SEQ ID NO: 556) |
| Cas12 Variant | CUCUACAACUGAUAAAGA AUUUCUACUUUUGUAGAU (SEQ ID NO: 525) | UCCUGCAGCAGAAAAUCA AAGACA (SEQ ID NO: 539) | CUCUACAACUGAUAAAGAAUUU CUACUUUUGUAGAUUCCUGCAG CAGAAAAUCAAAGACA (SEQ ID NO: 557) |

TABLE 30-continued

Cas12 Ortholog Pre-crRNA Sequences

| Cas12 Ortholog SEQ ID NO | Repeat Sequence | Spacer Sequence | Pre-crRNA Sequence |
|---|---|---|---|
| Cas12 Variant | CUCUAGCAGGCCUGGCAA AUUUCUACUGUUGUAGAU (SEQ ID NO: 526) | UCCUGCAGCAGAAAAUCA AAGACA (SEQ ID NO: 539) | GCCAAAUACCUCUAUAAAAUUU CUACUUUUGUAGAUUCCUGCAG CAGAAAAUCAAAGACA (SEQ ID NO: 559) |
| Cas12 Variant | GCCAAAUACCUCUAUAAA AUUUCUACUUUUGUAGAU (SEQ ID NO: 527) | UCCUGCAGCAGAAAAUCA AAGACA (SEQ ID NO: 539) | GCCAAAUACCUCUAUAAAAUUU CUACUUUUGUAGAUUCCUGCAG CAGAAAAUCAAAGACA (SEQ ID NO: 559) |
| Cas12 Variant | GCCAAGAACCUAUAGAUA AUUUCUACUGUUGUAGAU (SEQ ID NO: 528) | UCCUGCAGCAGAAAAUCA AAGACA (SEQ ID NO: 539) | GCCAAGAACCUAUAGAUAAUUU CUACUGUUGUAGAUUCCUGCAG CAGAAAAUCAAAGACA (SEQ ID NO: 560) |
| Cas12 Variant | GGCUAUAAAGCUUAUUUA AUUUCUACUAUUGUAGAU (SEQ ID NO: 529) | UCCUGCAGCAGAAAAUCA AAGACA (SEQ ID NO: 539) | GGCUAUAAAGCUUAUUUAAUUU CUACUAUUGUAGAUUCCUGCAG CAGAAAAUCAAAGACA (SEQ ID NO: 561) |
| SEQ ID NO: 2 | GUCAAAAGACCUUUUUAA UUUCUACUCUUGUAGAU (SEQ ID NO: 530) | UCCUGCAGCAGAAAAUCA AAGACA (SEQ ID NO: 539) | GUCAAAAGACCUUUUUAAUUUC UACUCUUGUAGAUUCCUGCAGC AGAAAAUCAAAGACA (SEQ ID NO: 562) |
| Cas12 Variant | GUCUAAAACUCAUUCAGA AUUUCUACUAGUGUAGAU (SEQ ID NO: 531) | UCCUGCAGCAGAAAAUCA AAGACA (SEQ ID NO: 539) | GUCUAAAACUCAUUCAGAAUUU CUACUAGUGUAGAUUCCUGCAG CAGAAAAUCAAAGACA (SEQ ID NO: 563) |
| Cas12 Variant | GUCUAACUACCUUUUAAU UUCUACUGUUUGUAGAU (SEQ ID NO: 532) | UCCUGCAGCAGAAAAUCA AAGACA (SEQ ID NO: 539) | GUCUAACUACCUUUUAAUUUCU ACUGUUUGUAGAUUCCUGCAGC AGAAAAUCAAAGACA (SEQ ID NO: 564) |
| Cas12 Variant | GUCUAUAAGACAUUUAUA AUUUCUACUAUUGUAGAU (SEQ ID NO: 533) | UCCUGCAGCAGAAAAUCA AAGACA (SEQ ID NO: 539) | GUCUAUAAGACAUUUAUAAUUU CUACUAUUGUAGAUUCCUGCAG CAGAAAAUCAAAGACA (SEQ ID NO: 565) |
| Cas12 Variant | GUUUAAAACCACUUUAAA AUUUCUACUAUUGUAGAU (SEQ ID NO: 534) | UCCUGCAGCAGAAAAUCA AAGACA (SEQ ID NO: 539) | GUUUAAAACCACUUUAAAAUUU CUACUAUUGUAGAUUCCUGCAG CAGAAAAUCAAAGACA (SEQ ID NO: 566) |
| Cas12 Variant | GUUUAAAAGUCCUAUUGG AUUUCUACUUUUGUAGAU (SEQ ID NO: 535) | UCCUGCAGCAGAAAAUCA AAGACA (SEQ ID NO: 539) | GUUUAAAAGUCCUAUUGGAUUU CUACUUUUGUAGAUUCCUGCAG CAGAAAAUCAAAGACA (SEQ ID NO: 567) |
| Cas12 Variant | UGCUUAGAACAUUUAAAG AAUUUCUACUAUUGUAGA U (SEQ ID NO: 536) | UCCUGCAGCAGAAAAUCA AAGACA (SEQ ID NO: 539) | UGCUUAGAACAUUUAAAGAAUU CUACUAUUGUAGAUUCCUGCA GCAGAAAAUCAAAGACA (SEQ ID NO: 568) |
| Cas12 Variant | UGCUUAGUACUUAUAAAG AAUUUCUACUAUUGUAGA U (SEQ ID NO: 537) | UCCUGCAGCAGAAAAUCA AAGACA (SEQ ID NO: 539) | UGCUUAGUACUUAUAAAGAAUU CUACUAUUGUAGAUUCCUGCA GCAGAAAAUCAAAGACA (SEQ ID NO: 569) |
| MAD7 | GUUAAGUUAUAUAGAAUA AUUUCUACU (SEQ ID NO: 538) | UCCUGCAGCAGAAAAUCA AAGACA (SEQ ID NO: 539) | GUUAAGUUAUAUAGAAUAAUUU CUACUUCCUGCAGCAGAAAAUC AAAGACA (SEQ ID NO: 570) |

Example 37

Cis Cleavage Activity of Cas12 Variants

This example describes the cis cleavage activity of Cas12 variants. Cis (target) cleavage assays were performed at 25° C. or 37° C. in activity buffer (120 mM NaCl, 5 mM MgCl$_2$, 20 mM Tris pH 7.5, 1% glycerol). Cas12 variant-crRNA complex formation was performed in activity buffer at a molar ratio of 1:1.25 protein to crRNA at 37° C. for 10 min. The cis cleavage target was a 1200 bp PCR product that contained the target sequence at the 700th position. A restriction site for BamHI was introduced near the target sequence. Unless otherwise indicated, the final concentrations of protein, guide and targets were 100 nM, 125 nM and 15 nM, respectively, for all reactions. Cis cleavage assays were performed in the presence of activity buffer. Target dsDNA was detected at a final concentration of 15 nM Target dsDNA was obtained by annealing complementary ssDNA primers at a ratio of 2:1 of non-target strand to target strand in hybridization buffer (50 mM NaCl, 1 mM Tris pH 8.0, 0.1 mM EDTA), to ensure double-stranded DNA is being detected instead of single-stranded DNA. The protein of interest and the guide RNA were added to each tube and incubated for 20 minutes at 37° C. Each reaction contained 16 µL of the incubated mastermix. Reactions were quenched with 6× loading dye and resolved by pre-stained 2% agarose gel in 1×TAE buffer. FIG. 91 shows cis cleavage activity of different Cas variants after incubation with a target nucleic acid sequence for 10 minutes. Cleavage with BamHI is shown as a cleavage positive control. Different Cas12 variants demonstrate different rates of cis cleavage activity.

Example 38

Trans Cleavage Activity of a Cas12 Variant with Different gRNAs

This example describes the trans cleavage activity of a Cas12 variant of SEQ ID NO: 11 with different gRNAs. A detection assay was performed using gRNAs with either the repeat sequence of LbCas12a (SEQ ID NO: 1) or the repeat sequence of the Cas12 variant of SEQ ID NO: 11. Target nucleic acid was detected at a final concentration of 1 nM or 0 nM (negative control).

FIG. 93 shows the results of an assay comparing DETECTR assay efficiency for a Cas12 variant of SEQ ID NO: 11 with two different gRNAs. The gRNA contains either the LbCas12a repeat sequence ("gRNA #1," SEQ ID NO: 423, UAAUUUCUACUAAGUGUAGAUUCAU-CACGCAGCUCAUGCCC) or the Cas12 variant repeat sequence ("gRNA #2," SEQ ID NO: 424, GUUUGGUAC-CUUUAUUAAUUUCUACUAAGUGUAGAUUCAU-CACGCAGCUCAUGCC C). The detection reaction was performed at 37° C. for 30 minutes with 1 nM target DNA. A sample with 0 nM target DNA was tested as a negative control. The results indicated that the Cas12 variant is compatible with the gRNA corresponding to the repeat sequence of LbCas12a ("gRNA #1," SEQ ID NO: 423). Results further indicated that the Cas12 variant showed increased trans cleavage activity in the presence of the shorter gRNA ("gRNA #1," SEQ ID NO: 423).

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (766 sequences)

SEQ ID NO: 1 - protein, 1228 aa, Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 3 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 4 - protein, 1246 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 5 - protein, 1373 aa, Moraxella bovoculi
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 6 - protein, 1259 aa, Moraxella bovoculi
MGIHGVPAALFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 7 - protein, 1269 aa, Moraxella bovoculi
MGIHGVPAALFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMIYKLLPGPNKMLPKVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 8 - protein, 1306 aa, Thiomicrospira sp.
MGIHGVPAATKTFDSEFFNLYSLQKTVRFELKPVGETASFVEDFKNEGLKRVVSEDERRAVDYQKVKEIIDDYHRDFIEESLNYFPEQVSKDALEQAFHLYQKLKAAKVEEREKALKEWEALQKKLREKVVKCFSDSNKARFSRIDKKELIKEDLINWLVAQNREDDIPTVETFNNFTTYFTGFHENRKNIYSKDDHATAISFRLIHENLPKFFDNVISFNKLKEGFPELKFDKVKEDLEVDYDLKHAFEIEYFVNFVTQAGIDQYNYLLGGKTLEDGTKKQGMNEQINLFKQQQTRDKARQIPKLIPLFKQILSERTESQSFIPKQFESDQELFDSLQKLHNNCQDKFTVLQQAILGLAEADLKKVFIKTSDLNALSNTIFGNYSVFSDALNLYKESLKTKKAQEAFEKLPAHSIHDLIQYLEQFNSSLDAEKQQSTDTVLNYFIKTDELYSRFIKSTSEAFTQVQPLFELEALSSKRRPPESEDEGAKGQEGFEQIKRIKAYLDTLMEAVHFAKPLYLVKGRKMIEGLDKDQSFYEAFEMAYQELESLIIPIYNKARSYLSRKPFKADKFKINFDNNTLLSGWDANKETANASILFKKDGLYYLGIMPKGKTFLFDYFVSSEDSEKLKQRRQKTAEEALAQDGESYFEKIRYKLLPGASKMLPKVFFSNKNIGFYNPSDDILRIRNTASHTKNGTPQKGHSKVEFNLNDCHKMIDFFKSSIQKHPEWGSFGFTFSDTSDFEDMSAFYREVENQGYVISFDKIKETYIQSQVEQGNLYLFQIYNKDFSPYSKGKPNLHTLYWKALFEEANLNNVVAKLNGEAEIFFRRHSIKASDKVVHPANQAIDNKNPHTEKTQSTFEYDLVKDKRYTQDKFFFHVPISLNFKAQGVSKFNDKVNGFLKGNPDVNIIGIDRGERHLLYFTVVNQKGEILVQESLNTLMSDKGHVNDYQQKLDKKEQERDAARKSWTTVENIKELKEGYLSHVVHKLAHLIIKYNAIVCLEDLNFGFKRGRFKVEKQVYQKFEKALIDKLNYLVFKEKELGEVGHYLTAYQLTAPFESFKKLGKQSGILFYVPADYTSKIDPTTGFVNFLDLRYQSVEKAKQLLSDFNAIRFNSVQNYFEFEIDYKKLTPKRKVGTQSKWVICTYGDVRYQNRRNQKGHWETEEVNVTEKLKALFASDSKTTTVIDYANDDNLIDVILEQDKASFFKELLWLLKLTMTLRHSKIKSEDDFILSPVKNEQGEFYDSRKAGEVWPKDADANGAYHIALKGLWNLQQINQWEKGKTLNLAIKNQDWFSFIQEKPYQE

SEQ ID NO: 9 - protein, 1214 aa, Butyrivibrio sp.
MGIHGVPAAYYQNLTKKYPVSKTIRNELIPIGKTLENIRKNNILESDVKRKQDYEHVKGIMDEYHKQLINEALDNYMLPSLNQAAEIYLKKHVDVEDREEFKKTQDLLRREVTGRLKEHENYTKIGKKDILDLLEKLPSISEEDYNALESFRNFYTYFTSYNKVRENLYSDEEKSSTVAYRLINENLPKFLDNIKSYAFVKAAGVLADCIEEEEQDALFMVETFNMTLTQEGIDMYNYQIGKVNSAINLYNQKNHKVEEFKKIPKMKVLYKQILSDREEVFIGEFKDDETLLSSIGAYGNVLMTYLKSEKINIFFDALRESEGKNVYVKNDLSKTTMSNIVFGSWSAFDELLNQEYDLANENKKKDDKYFEKRQKELKKNKSYTLEQMSNLSKEDISPIENYIERISEDIEKICIYNGEFEKIVVNEHDSSRKLSKNIKAVKVIKDYLDSIKELEHDIKLINGSGQELEKNLVVYVGQEEALEQLRPVDSLYNLTRNYLTKKPFSTEKVKLNFNKSTLLNGWDKNKETDNLGILFFKDGKYYLGIMNTTANKAFVNPPAAKTENVFKKVDYKLLPGSNKMLPKVFFAKSNIGYYNPSTELYSNYKKGTHKKGPSFSIDDCHNLIDFFKESIKKHEDWSKFGFEFSDTADYRDISEFYREVEKQGYKLTFTDIDESYINDLIEKNELYLFQIYNKDFSEYSKGKLNLHTLYFMMLFDQRNLDNVVYKLNGEAEVFYRPASIAENELVIHKAGEGIKNKNPNRAKVKETSTFSYDIVKDKRYSKYKFTLHIPITMNFGVDEVRRFNDVINNALRTDDNVNVIGIDRGERNLLYVVVINSEGKILEQISLNSIINKEYDIETNYHALLDEREDDRNKARKDWNTIENIKELKTGYLSQVVNVVAKLVLKYNAIICLEDLNFGFKRGRQKVEKQVYQKFEKMLIEKLNYLVIDKSREQVSPEKMGGALNALQLTSKFKSFAELGKQSGIIYYVPAYLTSKIDPTTGFVNLFYIKYENIEKAKQFFDGFDFIRFNKKDDMFEFSFDYKSFTQKACGIRSKWIVYTNGERIIKYPNPEKNNLFDEKVINVTDEIKGLFKQYRIPYENGEDIKEIIISKAEADFYKRLFRLLHQTLQMRNSTSDGTRDYIISPVKNDRGEFFCSEFSEGTMPKDADANGAYNIARKGLWVLEQIRQKDEGEKVNLSMTNAEWLKYAQLHLL

SEQ ID NO: 10 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 11 - protein, 1224 aa, Unknown
  source: /note="Description of Unknown: Cas12 variant sequence"
MKKIDNFVGCYPVSKTLRFKAIPIGKTQENIEKKRLVEEDEVRAKDYKAVKKLIDRYHREFIEGVLDNVKLDGLEEYYMLFNKSDREESDNKKIEIMEERFRRVISKSFKNNEEYKKIFSKKIIEEILPNYIKDEEEKELVKGFKGFYTAFVGYAQNRENMYSDEKKSTAISYRIVNENMPRFITNIKVFEKAKSILDVDKINEINEYILNNDYYVDDFFNIDFFNYVLNQKGIDIYNAIIGGIVTGDGRKIQGLNECINLYNQENKKIRLPQFKPLYKQILSESESMSFYIDEIESDDMLIDMLKESLQIDSTINNAIDDLKVLFNNIFDYDLSGIFINNGLPITTISNDVYGQWSTISDGWNERYDVLSNAKDKESEKYFEKRRKEYKKVKSFSISDLQELGGKDLSICKKINEIISEMIDDYKSKIEEIQYLFDIKELEKPLVTDLNKIELIKNSLDGLKRIERYVIPFLGTGKEQNRDEVFYGYFIKCIDAIKEIDGVYNKTRNYLTKKPYSKDKFKLYFENPQLMGGWDRNKESDYRSTLLRKNGKYYVAIIDKSSSNCMMNIEEDENDNYEKINYKLLPGPNKMLPKVFFSKKNREYFAPSKEIERIYSTGTFKKDTNFVKKDCENLITFYKDSLDRHEDWSKSFDFSFKESSAYRDISEFYRDVEKQGYRVSFDLLSSNAVNTLVEEGKLYLFQLYNKDFSEKSHGIPNLHTMYFRSLFDDNNKGNIRLNGGAEMFMRRASLNKQDVTVHKANQPIKNKNLLNPKKTTTLPYDVYKDKRFTEDQYEVHIPITMNKVPNNPYKINHMVREQLVKDDNPYVIGIDRGERNLIYVVVVDGQGHIVEQLSLNEIINENNGISIRTDYHTLLDAKERERDESRKQWKQIENIKELKEGYISQVVHKICELVEKYDAVIALEDLNSGFKNSRVKVEKQVYQKFEKMLITKLNYMVDKKKDYNKPGGVLNGYQLTTQFESFSKMGTQNGIMFYIPAWLTSKMDPTTGFVDLLKPKYKNKADAQKFFSQFDSIRYDNQEDAFVFKVNYTKFPRTDADYNKEWEIYTNGERIRVFRNPKKNNEYDYETVNVSERMKELFDSYDLLYDKGELKETICEMEESKFFEELIKLFRLTLQMRNSISGRTDVDYLISPVKNSNGYFYNSNDYKKEGAKYPKDADANGAYNIARKVLWAIEQFKMADEDKLDKTKISIKNQEWLEYAQTHCE

SEQ ID NO: 12 - protein, 500 aa, Unknown
  source: /note="Description of Unknown: Cas14 sequence"
MEVQKTVMKTLSLRILRPLYSQEIEKEIKEEKERRKQAGGTGELDGGFYKKLEKKHSEMFSFDRLNLLLNQLQREIAKVYNHAISELYIATIAQGNKSNKHYISSIVYNRAYGYFYNAYIALGICSKVEANFRSNELLTQQSALPTAKSDNFPIVLHKQKGAEGEDGGFRISTEGSDLIFEIPIPFYEYNGENRKEPYKWVKKGGQKPVLKLILSTFRRQRNKGWAKDEGTDAEIRKVTEGKYQVSQIEINRGKKLGEHQKWFANFSIEQPIYERKPNRSIVGGLDVGIRSPLVCAINNSFSRYSVDSNDVFKFSKQVFAFRRRLLSKNSLKRKGHGAAHKLEPITEMTEKNDKFRKKIIERWAKEVTNFFVKNQVGIVQIEDLSTMKDREDHFFNQYLRGFWPYYQMQTLIENKLKEYGIEVKRVQAKYTSQLCSNPNCRYWNNYFNFEYRKVNKFPKFKCEKCNLEISADYNAARNLSTPDIEKFVAKATKGINLPEK

SEQ ID NO: 13 - protein, 507 aa, Unknown
  source: /note="Description of Unknown: Cas14 sequence"
MEEAKTVSKTLSLRILRPLYSAEIEKEIKEEKERRKQGGKSGELDSGFYKKLEKKHTQMFGWDKLNLMLSQLQRQIARVFNQSISELYIETVIQGKKSNKHYTSKIVYNRAYSVFYNAYLALGITSKVEANFRSTELLMQKSSLPTAKSDNFPILLHKQKGVEGEEGGFKISADGNDLIFEIPIPFYEYDSANKKEPFKWIKKGGQKPTIKLILSTFRRQRNKGWAKDEGTDAEIRKVIEGKYQVSHIEINRGKKLGDHQKWFVNFTIEQPIYERKLDKNIIGGIDVGIKSPLVCAVNNSFARYSVDSNDVLKFSKQAFAFRRRLLSKNSLKRSGHGSKNKLDPITRMTEKNDRFRKKIIERWAKEVTNFFIKNQVGTVQIEDLSTMKDRQDNFFNQYLRGFWPYYQMQNLIENKLKEYGIETKRIKARYTSQLCSNPSCRHWNSYFSFDHRKTNNFPKFKCEKCALEISADYNAARNISTPDIEKFVAKATKGINLPDKNENVILE

SEQ ID NO: 14 - protein, 529 aa, Unknown
  source: /note="Description of Unknown: Cas14 sequence"
MAKNTITKTLKLRIVRPYNSAEVEKIVADEKNNREKIALEKNKDKVKEACSKHLKVAAYCTTQVERNACLFCKARKLDDKFYQKLRGQFPDAVFWQEISEIFRQLQKQAAEIYNQSLIELYYEIFIKGKGIANASSVEHYLSDVCYTRAAELFKNAAIASGLRSKIKSNFRLKELKNMKSGLPTTKSDNFPIPLVKQKGGQYTGFEISNHNSDFIIKIPFGRWQVKKEIDKYRPWEKFDFEQVQKSPKPISLLLSTQRRKRNKGWSKDEGTEAEIKKVMNGDYQTSYIEVKRGSKIGEKSAWMLNLSIDVPKIDKGVDPSIIGGIDVGVKSPLVCAINNAFSRYSISDNDLFHFNKKMFARRRILLKKNRHKRAGHGAKNKLKPITILTEKSERFRKKLIERWACEIADFFIKNKVGTVQMENLESMKRKEDSYFNIRLRGFWPYAEMQNKIEFKLKQYGIEIRKVAPNNTSKTCSKCGHLNNYFNFEYRKKNKFPHFKCEKCNFKENADYNAALNISNPKLKSTKEEP

SEQ ID NO: 15 - protein, 726 aa, Unknown
  source: /note="Description of Unknown: Cas14 sequence"
MERQKVPQIRKIVRVVPLRILRPKYSDVIENALKKFKEKGDDTNTNDFWRAIRDRDTEFFRKELNFSEDEINQLERDTLFRVGLDNRVLFSYFDFLQEKLMKDYNKIISKLFINRQSKSSFENDLTDEEVEELIEKDVTPFYGAYIGKGIKSVIKSNLGGKFIKSVKIDRETKKVTKLTAINIGLMGLPVAKSDTFPIKIIKTNPDYITFQKSTKENLQKIEDYETGIEYGDLLVQITIPWFKNENKDFSLIKTKEAIEYYKLNGVGKKDLLNINLVLTTYHIRKKKSWQIDGSSQSLVREMANGELEEKWKSFFDTFIKKYGDEGKSALVKRRVNKKSRAKGEKGRELNLDERIKRLYDSIKAKSFPSEINLIPENYKWKLHFSIEIPPMVNDIDSNLYGGIDFGEQNIATLCVKNIEKDDYDFLTIYGNDLLKHAQASYARRRIMRVQDEYKARGHGKSRKTKAQEDYSERMQKLRQKITERLVKQISDFFLWRNKFHMAVCSLRYEDLNTLYKGESVKAKRMRQFINKQQLFNGIERKLKDYNSEIYVNSRYPHYTSRLCSKCGKLNLYFDFLKFRTKNIIIRKNPDGSEIKYMPFFICEFCGWKQAGDKNASANIADKDYQDKLNKEKEFCNIRKPKSKKEDIGEENEEERDYSRRFNRNSFIYNSLKKDNKLNQEKLFDEWKNQLKRKIDGRNKFEPKEYKDRFSYLFAYYQEIIKNESES

SEQ ID NO: 16 - protein, 517 aa, Unknown
  source: /note="Description of Unknown: Cas14 sequence"
MVPTELITKTLQLRVIRPLYFEEIEKELAELKEQKEKEFEETNSLLLESKKIDAKSLKKLKRKARSSAAVEFWKIAKEKYPDILTKPEMEFIFSEMQKMMARFYNKSMTNIFIEMNNDEKVNPLSLISKASTEANQVIKCSSISSGLNRKIAGSINKTKFKQVRDGLISLPTARTETFPISFYKSTANKDEIPISKINLPSEEEADLTITLPFPFFEIKKEKKGQKAYSYFNIIEKSGRSNNKIDLLLSTHRRQRRKGWKEEGGTSAEIRRLMEGEFDKEWEIYLGEAEKSEKAKNDLIKNMTRGKLSKDIKEQLEDIQVKYFSDNNVESWNDLSKEQKQELSKLRKKKVEELKDWKHVKEILKTRAKIGWVELKRGKRQRDRNKWFVNITITRPPFINKELDDTKFGGIDLGVKVPFVCAVHGSPARLIIKENEILQFNKMVSARNRQITKDSEQRKGRGKKNKFIKKEIFNERNELFRKKIIERWANQIVKFFEDQKCATVQIENLESFDRTSYK

SEQ ID NO: 17 - protein, 481 aa, Unknown
  source: /note="Description of Unknown: Cas14 sequence"
MKSDTKDKKIIIHQTKTLSLRIVKPQSIPMEEFTDLVRYHQMIIFPVYNNGAIDLYKKLFKAKIQKGNEARAIKYFMNKIVYAPIANTVKNSYIALGYSTKMQSSFSGKRLWDLRFGEATPPTIKADFPLPFYNQSGFKVSSENGEFIIGIPFGQYTKKTVSDIEKKTSFAWDKFTLEDTTKKTLIELLLSTKTRKMNEGWKNNEGTEAEIKRVMDGTYQVTSLEILQRDDSWFVNFNIAYDSLKKQPDRDKIAGIHMGITRPLTAVIYNNKYRALSIYPNTVMHLTQKQLARIKEQRTNSKYATGGHGRNAKVTGTDTLSEAYRQRRKKIIEDWIASIVKFAINNEIGTIYLEDISNTNSFFAAREQKLIYLEDISNTNSFLSTYKYPISAISDTLQHKLEEKAIQVIRKKAYYVNQICSLCGHYNKGFTYQFRRKNKFPKMKCQGCLEATSTEFNAAANVANPDYEKLLIKHGLLQLKK

SEQ ID NO: 18 - protein, 358 aa, Unknown
  source: /note="Description of Unknown: Cas14 sequence"
MSTITRQVRLSPTPEQSRLLMAHCQQYISTVNVLVAAFDSEVLTGKVSTKDFRAALPSAVKNQALRDAQSVFKRSVELGCLPVLKKPHCQWNNQNWRVEGDQLILPICKDGKTQQERFRCAAVALEGKAGILRIKKKRGKWIADLTVTQEDAPESSGSAIMGVDLGIKVPAVAHIGGKGTRFFGNGRSQRSMRRRFYARRKTLQKAKKLRAVRKSKGKEARWMKTINHQLSRQIVNHAHALGVGTIKIEALQGIRKGTTRKSRGAAARKNNRMTNTWSFSQLTLFITYKAQRQGITVEQVDPAYTSQDCPACRARNGAQDRTYVCSECGWRGHRDTVGAINISRRAGLSGHRRGATGA

SEQ ID NO: 19 - protein, 507 aa, Unknown
  source: /note="Description of Unknown: Cas14 sequence"
MIAQKTIKIKLNPTKEQIIKLNSIIEEYIKVSNFTAKKIAEIQESFTDSGLTQGTCSECGKEKTYRKYHLLKKDNKLFCITCYKRKYSQFTLQKVEFQNKTGLRNVAKLPKTYYTNAIRFASDTFSGFDEIIKKKQNRLNSIQNRLNFWKELLYNPSNRNEIKIKVVKYAPKTDTREHPHYYSEAEIKGRIKRLEKQLKKFKMPKYPEFTSETISLQRELYSWKNPDELKISSITDKNESMNYYGKEYLKRYIDLINSQTPQILLEKENNSFYLCFPITKNIEMPKIDDTFEPVGIDWGITRNIAVVSILDSKTKKPKFVKFYSAGYILGKRKHYKSLRKHFGQKKRQDKINKLGTKEDRFIDSNIHKLAFLIVKEIRNHSNKPIILMENITDNREEAEKSMRQNILLHSVKSRLQNYIAYKALWNNIPTNLVKPEHTSQICNRCGHQDRENRPKGSKLFKCVKCNYMSNADFNASINIARKFYIGEYEPFYKDNEKMKSGVNSISM

SEQ ID NO: 20 - protein, 534 aa, Unknown
  source: /note="Description of Unknown: Cas14 sequence"
LKLSEQENITTGVKFKLKLDKETSEGLNDYFDEYGKAINFAIKVIQKELAEDRFAGKVRLDENKKPLLNEDGKKIWDFPNEFCSCGKQVNRYVNGKSLCQECYKNKFTEYGIRKRMYSAKGRKAEQDINIKNSTNKISKTHFNYAIREAFILDKSIKKQRKERFRRLREMKKKLQEFIEIRDGNKILCPKIEKQRVERYIHPSWINKEKKLEDFRGYSMSNVLGKIKILDRNIKREEKSLKEKGQINFKARRLMLDKSVKFLNDNKISFTISKNLPKEYELDLPEKEKRLNWLKEKIKIIKNQKPKYAYLLRKDDNFYLQYTLETEFNLKEDYSGIVGIDRGVSHIAVYTFVHNNGKNERPLFLNSSEILRLKNLQKERDRFLRRKHNKKRKKSNMRNIEKKIQLILHNYSKQIVDFAKNKNAFIVFEKLEKPKKNRSKMSKKSQYKLSQFTFKKLSDLVDYKAKREGIKVLYISPEYTSKECSHCGEKVNTQRPFNGNSSLFKCNKCGVELNADYNASINIAKKGLNILNSTN

SEQ ID NO: 21 - protein, 537 aa, Unknown
  source: /note="Description of Unknown: Cas14 sequence"
MEESIITGVKFKLRIDKETTKKLNEYFDEYGKAINFAVKIIQKELADDRFAGKAKLDQNKNPILDENGKKIYEFPDEFCSCGKQVNKYVNNKPFCQECYKIRFTENGIRKRMYSAKGRKAEHKINILNSTNKISKTHFNYAIREAFILDKSIKKQRKKRNERLRESKKRLQQFIDMRDGKREICPTIKGQKVDRFIHPSWITKDKKLEDFRGYTLSIINSKIKILDRNIKREEKSLKEKGQIIFKAKRLMLDKSIRFVGDRKVLFTISKTLPKEYELDLPSKEKRLNWLKEKIEIIKNQKPKYAYLLRKNIESEKKPNYEYYLQYTLEIKPELKDFYDGAIGIDRGINHIAVCTFISNDGKVTPPKFFSSGEILRLKNLQKERDRFLLRKHNKNRKKGNMRVIENKINLILHRYSKQIVDMAKKLNASIVFEELGRIGKSRTKMKKSQRYKLSLFIFKKLSDLVDYKSRREGIRVTYVPPEYTSKECSHCGEKVNTQRPFNGNYSLFKCNKCGIQLNSDYNASINIAKKGLKIPNST

SEQ ID NO: 22 - protein, 540 aa, Unknown
  source: /note="Description of Unknown: Cas14 sequence"
LWTIVIGDFIEMPKQDLVTTGIKFKLDVDKETRKKLDDYFDEYGKAINFAVKIIQKNLKEDRFAGKIALGEDKKPLLDKDGKKIYNYPNESCSCGNQVRRYVNAKPFCVDCYKLKFTENGIRKRMYSARGRKADSDINIKNSTNKISKTHFNYAIREGFILDKSLKKQRSKRIKKLLELKRKLQEFIDIRQGQMVLCPKIKNQRVDKFIHPSWLKRDKKLEEFRGYSLSVVEGKIKIFNRNILREEDSLRQRGHVNFKANRIMLDKSVRFLDGGKVNFNLNKGLPKEYLLDLPKKENKLSWLNEKISLIKLQKPKYAYLLRREGSFFIQYTIENVPKTFSDYLGAIGIDRGISHIAVCTFVSKNGVNKAPVFFSSGEILKLKSLQKQRDLFLRGKHNKIRKKSNMRNIDNKINLILHKYSRNIVNLAKSEKAFIVFEKLEKIKKSRFKMSKSLQYKLSQFTFKKLSDLVEYKAKIEGIKVDYVPPEYTSKECSHCGEKVDTQRPFNGNSSLFKCNKCRVQLNADYNASINIAKKSLNISN

SEQ ID NO: 23 - protein, 542 aa, Unknown
  source: /note="Description of Unknown: Cas14 sequence"
MSKTTISVKLKIIDLSSEKKEFLDNYFNEYAKATTFCQLRIRRLLRNTHWLGKKEKSSKKWIFESGICDLCGENKELVNEDRNSGEPAKICKRCYNGRYGNQMIRKLFVSTKKREVQENMDIRRVAKLNNTHYHRIPEEAFDMIKAADTAEKRRKKNVEYDKKRQMEFIEMFNDEKKRAARPKKPNERETRYVHISKLESPSKGYTLNGIKRKIDGMGKKIERAEKGLSRKKIFGYQGNRIKLDSNWVRFDLAESEITIPSLFKEMKLRITGPTNVHSKSGQIYFAEWFERINKQPNNYCYLIRKTSSNGKYEYYLQYTYEAEVEANKEYAGCLGVDIGCSKLAAAVYYDSKNKKAQKPIEIFTNPIKKIKMRREKLIKLLSRVKVRHRRRKLMQLSKTEPIIDYTCHKTARKIVEMANTAKAFISMENLETGIKQKQQARETKKQKFYRNMFLFRKLSKLIEYKALLKGIKIVYVKPDYTSQTCSSCGADKEKTERPSQAIFRCLNPTCRYYQRDINADFNAAVNIAKKALNNTEVVTTLL

SEQ ID NO: 24 - protein, 564 aa, Unknown
  source: /note="Description of Unknown: Cas14 sequence"
MARAKNQPYQKLTTTTGIKFKLDLSEEEGKRFDEYFSEYAKAVNFCAKVIYQLRKNLKFAGKKELAAKEWKFEISNCDFCNKQKEIYYKNIANGQKVCKGCHRTNFSDNAIRKKMIPVKGRKVESKFNIHNTTKKISGTHRHWAFEDAADIIESMDKQRKEKQKRLRREKRKLSYFFELFGDPAKRYELPKVGKQRVPRYLHKIIDKDSLTKKRGYSLSYIKNKIKISERNIERDEKSLRKASPIAFGARKIKMSKLDPKRAFDLENNVFKIPGKVIKGQYKFFGTNVANEHGKKFYKDRISKILAGKPKYFYLLRKKVAESDGNPIFEYYVQWSIDTETPAITSYDNILGIDAGITNLATTVLIPKNLSAEHCSHCGNNHVKPIFTKFFSGKELKAIKIKSRKQKYFLRGKHNKLVKIKRIRPIEQKVDGYCHVVSKQIVEMAKERNSCIALEKLEKPKKSKFRQRRREKYAVSMFVFKKLATFIKYKAAREGIEIIPVEPEGTSYTCSHCKNAQNNQRPYFKPNSKKSWTSMFKCGKCGIELNSDYNAAFNIAQKALNMTSA

SEQ ID NO: 25 - protein, 610 aa, Unknown
  source: /note="Description of Unknown: Cas14 sequence"
MDEKHFFCSYCNKELKISKNLINKISKGSIREDEAVSKAISIHNKKEHSLILGIKFKLFIENKLDKKKLNEYFDNYSKAVTFAARIFDKIRSPYKFIGLKDKNTKKWTFPKAKCVFCLEEKEVAYANEKDNSKICTECYLKEFGENGIRKKIYSTRGRKVEPKYNIFNSTKELSSTHYNYAIRDAFQLLDALKKQRQKKLKSIFNQKLRLKEFEDIFSDPQKRIELSLKPHQREKRYIHLSKSGQESINRGYTLRFVRGKIKSLTRNIEREEKSLRKKTPIHFKGNRLMIFPAGIKFDFASNKVKISISKNLPNEFNFSGTNVKNEHGKSFFKSRIELIKTQKPKYAYVLRKIKREYSKLRNYEIEKIRLENPNADLCDFYLQYTIETESRNNEEINGIIGIDRGITNLACLVLLKKGDKKPSGVKFYKGNKILGMKIAYRKHLYLLKGKRNKLRKQRQIRAIEPKINLILHQISKDIVKIAKEKNFAIALEQLEKPKKARFAQRKKEKYKLALFTFKNLSTLIEYKSKREGIPVIYVPPEKTSQMCSHCAINGDEHVDTQRPYKKPNAQKPSYSLFKCNKCGIELNADYNAAFNIAQKGLKTLMLNHSH

SEQ ID NO: 26 - protein, 369 aa, Unknown
  source: /note="Description of Unknown: Cas14 sequence"
MLQTLLVKLDPSKEQYKMLYETMERFNEACNQIAETVFAIHSANKIEVQKTVYYPIREKFGLSAQLTILAIRKVCEAYKRDKSIKPEFRLDGALVYDQRVLSWKGLDKVSLVTLQGRQIIPIKFGDYQKARMDRIRGQADLILVKGVFYLCVVVEVSEESPYDPKGVLGVDLGIKNLAVDSDGEVHSGEQTTNTRERLDSLKARLQSKGTKSAKRHLKKLSGRMAKFSKDVNHCISKKLVAKAKGTLMSIALEDLQGIRDRVTVRKAQRRNLHTWNFGLLRMFVDYKAKIAGVPLVFVDPRNTSRTCPSCGHVAKANRPTRDEFRCVSCGFAGAADHIAAMNIAFRAEVSQPIVTRFFVQSQAPSFRVG

SEQ ID NO: 27 - protein, 552 aa, Unknown
  source: /note="Description of Unknown: Cas14 sequence"
MDEEPDSAEPNLAPISVKLKLVKLDGEKLAALNDYFNEYAKAVNFCELKMQKIRKNLVNIRGTYLKEKKAWINQTGECCICKKIDELRCEDKNPDINGKICKKCYNGRYGNQMIRKLFVSTNKRAVPKSLDIRKVARLHNTHYHRIPPEAADIIKAIETAERKRRNRILFDERRYNELKDALENEEKRVARPKKPKEREVRYVPISKKDTPSKGYTMNALVRKVSGMAKKIERAKRNLNKRKKIEYLGRRILLDKNWVRFDFDKSEISIPTMKEFFGEMRFEITGPSNVMSPNGREYFTKWFDRIKAQPDNYCYLLRKESEDETDFYLQYTWRPDAHPKKDYTGCLGIDIGGSKLASAVYFDADKNRAKQPIQIFSNPIGKWKTKRQKVIKVLSKAAVRHKTKKLESLRNIEPRIDVHCHRIARKIVGMALAANAFISMENLEGGIREKQKAKETKKQKFSRNMFVFRKLSKLIEYKALMEGVKVVYIVPDYTSQLCSSCGTNNTKRPKQAIFMCQNTECRYFGKNINADFNAAINIAKKALNRKDIVRELS

SEQ ID NO: 28 - protein, 534 aa, Unknown
  source: /note="Description of Unknown: Cas14 sequence"
MEKNNSEQTSITTGIKFKLKLDKETKEKLNNYFDEYGKAINFAVRIIQMQLNDDRLAGKYKRDEKGKPILGEDGKKILEIPNDFCSCGNQVNHYVNGVSFCQECYKKRFSENGIRKRMYSAKGRKAEQDINIKNSTNKISKTHFNYAIREAFNLDKSIKKQREKRFKKLKDMKRKLQEFLEIRDGKRVICPKIEKQKVERYIHPSWINKEKKLEEFRGYSLSIVNSKIKSFDRNIQREEKSLKEKGQINFKAQRLMLDKSVKFLKDNKVSFTISKELPKTFELDLPKKEKKLNWLNEKLEIIKNQKPKYAYLLRKENNIFLQYTLDSIPEIHSEYSGAVGIDRGVSHIAVYTFLDKDGKNERPFFLSSSGILRLKNLQKERDKFLRKKHNKIRKKGNMRNIEQKINLILHEYSKQIVNFAKDKNAFIVFELLEKPKKSRERMSKKIQYKLSQFTFKKLSDLVDYKAKREGIKVIYVEPAYTSKDCSHCGERVNTQRPFNGNFSLFKCNKCGIVLNSDYNASLNIARKGLNISAN

SEQ ID NO: 29 - protein, 577 aa, Unknown
  source: /note="Description of Unknown: Cas14 sequence"
MAEEKFFFCEKCNKDIKIPKNYINKQGAEEKARAKHEHRVHALILGIKFKIYPKKEDISKLNDYFDEYAKAVTFTAKIVDKLKAPFLFAGKRDKDTSKKKWVFPVDKCSFCKEKTEINYRTKQGKNICNSCYLTEFGEQGLLEKIYATKGRKVSSSFNLFNSTKKLTGTHNNYVVKESLQLLDALKKQRSKRLKKLSNTRRKLKQFEEMFEKEDKRFQLPLKEKQRELRFIHVSQKDRATEFKGYTMNKIKSKIKVLRRNIEREQRSLNRKSPVFFRGTRIRLSPSVQFDDKDNKIKLTLSKELPKEYSFSGLNVANEHGRKFFAEKLKLIKENKSKYAYLLRRQVNKNNKKPIYDYYLQYTVEFLPNIITNYNGILGIDRGINTLACIVLLENKKEKPSFVKFFSGKGILNLKNKRRKQLYFLKGVHNKYRKQQKIRPIEPRIDQILHDISKQIIDLAKEKRVAISLEQLEKPQKPKFRQSRKAKYKLSQFNFKTLSNYIDYKAKKEGIRVIYIAPEMTSQNCSRCAMKNDLHVNTQRPYKNTSSLFKCNKCGVELNADYNAAFNIAQKGLKILNS

SEQ ID NO: 30 - protein, 613 aa, Unknown
  source: /note="Description of Unknown: Cas14 sequence"
MISLKLKLLPDEEQKKLLDEMFWKWASICTRVGFGRADKEDLKPPKDAEGVWFSLTQLNQANTDINDLREAMKHQKHRLEYEKNRLEAQRDDTQDALKNPDRREISTKRKDLFRPKASVEKGFLKLKYHQERYWVRRLKEINKLIERKTKTLIKIEKGRIKFKATRITLHQGSFKIRFGDKPAFLIKALSGKNQIDAPFVVVPEQPICGSVVNSKKYLDEITTNFLAYSVNAMLFGLSRSEEMLLKAKRPEKIKKKEEKLAKKQSAFENKKKELQKLLGRELTQQEEAIIEETRNQFFQDFEVKITKQYSELLSKIANELKQKNDFLKVNKYPILLRKPLKKAKSKKINNLSPSEWKYYLQFGVKPLLKQKSRRKSRNVLGIDRGLKHLLAVTVLEPDKKTFVWNKLYPNPITGWKWRRRKLLRSLKRLKRRIKSQKHETIHENQTRKKLKSLQGRIDDLLHNISRKIVETAKEYDAVIVVEDLQSMRQHGRSKGNRLKTLNYALSLFDYANVMQLIKYKAGIEGIQIYDVKPAGTSQNCAYCLLAQRDSHEYKRSQENSKIGVCLNPNCQNHKKQIDADLNAARVIASCYALKINDSQPFGTRKRFKKRTTN

SEQ ID NO: 31 - protein, 615 aa, Unknown
  source: /note="Description of Unknown: Cas14 sequence"
METLSLKLKLNPSKEQLLVLDKMFWKWASICTRLGLKKAEMSDLEPPKDAEGVWFSKTQLNQANTDVNDLRKAMQHQGKRIEYELDKVENRRNEIQEMLEKPDRRDISPNRKDLFRPKAAVEKGYLKLKYHKLGYWSKELKTANKLIERKRKTLAKIDAGKMKFKPTRISLHTNSFRIKFGEEPKIALSTTSKHEKIELPLITSLQRPLKTSCAKKSKTYLDAAILNFLAYSTNAALFGLSRSEEMLLKAKKPEKIEKRDRKLATKRESFDKKLKTLEKLLERKLSEKEKSVFKRKQTEFFDKFCITLDETYVEALHRIAEELVSKNKYLEIKKYPVLLRKPESRLRSKKLKNLKPEDWTYYIQFGFQPLLDTPKPIKTKTVLGIDRGVRHLLAVSIFDPRTKTFTFNRLYSNPIVDWKWRRRKLLRSIKRLKRRLKSEKHVHLHENQFKAKLRSLEGRIEDHFHNLSKEIVDLAKENNSVIVVENLGGMRQHGRGRGKWLKALNYALSHFDYAKVMQLIKYKAELAGVFVYDVAPAGTSINCAYCLLNDKDASNYTRGKVINGKKNTKIGECKTCKKEFDADLNAARVIALCYEKRLNDPQPFGTRKQFKPKKP

SEQ ID NO: 32 - protein, 775 aa, Unknown
  source: /note="Description of Unknown: Cas14 sequence"
MKALKLQLIPTRKQYKILDEMFWKWASLANRVSQKGESKETLAPKKDIQKIQFNATQLNQIEKDIKDLRGAMKEQQKQKERLLLQIQERRSTISEMLNDDNNKERDPHRPLNFRPKGWRKFHTSKHWVGELSKILRQEDRVKKTIERIVAGKISFKPKRIGIWSSNYKINFFKRKISINPLNSKGFELTLMTEPTQDLIGKNGGKSVLNNKRYLDDSIKSLLMFALHSRFFGLNNTDTYLLGGKINPSLVKYYKKNQDMGEFGREIVEKFERKLKQEINEQQKKIIMSQIKEQYSNRDSAFNKDYLGLINEFSEVFNQRKSERAEYLLDSFEDKIKQIKQEIGESLNISDWDFLIDEAKKAYGYEEGFTEYVYSKRYLEILNKIVKAVLITDIYFDLRKYPILLRKPLDKIKKISNLKPDEWSYYIQFGYDSINPVQLMSTDKFLGIDRGLTHLLAYSVFDKEKKEFIINQLEPNPIMGWKWKLRKVKRSLQHLERRIRAQKMVKLPENQMKKKLKSIEPKIEVHYHNISRKIVNLAKDYNASIVVESLEGGGLKQHGRKKNARNRSLNYALSLFDYGKIASLIKYKADLEGVPMYEVLPAYTSQQCAKCVLEKGSFVDPEIIGYVEDIGIKGSLLDSLFEGTELSSIQVLKKIKNKIELSARDNHNKEINLILKYNFKGLVIVRGQDKEEIAEHPIKEINGKFAILDFVYKRGKEKVGKKGNQKVRYTGNKKVGYCSKHGQVDADLNASRVIALCKYLDINDPILFGEQRKSFK

SEQ ID NO: 33 - protein, 777 aa, Unknown
  source: /note="Description of Unknown: Cas14 sequence"
MVTRAIKLKLDPTKNQYKLLNEMFWKWASLANRFSQKGASKETLAPKDGTQKIQFNATQLNQIKKDVDDLRGAMEKQGKQKERLLIQIQERLLTISEILRDDSKKEKDPHRPQNFRPFGWRRFHTSAYWSSEASKLTRQVDRVRRTIERIKAGKINFKPKRIGLWSSTYKINFLKKKINISPLKSKSFELDLITEPQQKIIGKEGGKSVANSKKYLDDSIKSLLIFAIKSRLFGLNNKDKPLFENIITPNLVRYHKKGQEQENFKKEVIKKFENKLKKEISQKQKEIIFSQIERQYENRDATFSEDYLRAISEFSEIFNQRKKERAKELLNSFNEKIRQLKKEVNGNISEEDLKILEVEAEKAYNYENGFIEWEYSEQFLGVLEKIARAVLISDNYFDLKKYPILIRKPTNKSKKITNLKPEEWDYYIQFGYGLINSPMKIETKNFMGIDRGLTHLLAYSIFDRDSEKFTINQLELNPIKGWKWKLRKVKRSLQHLERRMRAQKGVKLPENQMKKRLKSIEPKIESYYHNLSRKIVNLAKANNASIVVESLEGGGLKQHGRKKNSRHRALNYALSLFDYGKIASLIKYKSDLEGVPMYEVLPAYTSQQCAKCVLKKGSFVEPEIIGYIEEIGFKENLLTLLFEDTGLSSVQVLKKSKNKMTLSARDKEGKMVDLVLKYNFKGLVISQEKKKEEIVEFPIKEIDGKFAVLDSAYKRGKERISKKGNQKLVYTGNKKVGYCSVHGQVDADLNASRVIALCKYLGINEPIVFGEQRKSFK

SEQ ID NO: 34 - protein, 610 aa, Unknown
  source: /note="Description of Unknown: Cas14 sequence"
LDLITEPIQPHKSSSLRSKEFLEYQISDFLNFSLHSLFFGLASNEGPLVDFKIYDKIVIPKPEERFPKKESEEGKKLDSFDKRVEEYYSDKLEKKIERKLNTEEKNVIDREKTRIWGEVNKLEEIRSIIDEINEIKKQKHISEKSKLLGEKWKKVNNIQETLLSQEYVSLISNLSDELTNKKKELLAKKYSKFDDKIKKIKEDYGLEFDENTIKKEGEKAFLNPDKFSKYQFSSSYLKLIGEIARSLITYKGFLDLNKYPIIFRKPINKVKKIHNLEPDEWKYYIQFGYEQINNPKLETENILGIDRGLTHILAYSVFEPRSSKFILNKLEPNPIEGWKWKLRKLRRSIQNLERRWRAQDNVKLPENQMKKNLRSIEDKVENLYHNLSRKIVDLAKEKNACIVFEKLEGQGMKQHGRKKSDRLRGLNYKLSLFDYGKIAKLIKYKAEIEGIPIYRIDSAYTSQNCAKCVLESRRFAQPEEISCLDDFKEGDNLDKRILEGTGLVEAKIYKKLLKEKKEDFEIEEDIAMFDTKKVIKENKEKTVILDYVYTRRKEIIGTNHKKNIKGIAKYTGNTKIGYCMKHGQVDADLNASRTIALCKNFDINNPEIWK

SEQ ID NO: 35 - protein, 632 aa, Unknown
  source: /note="Description of Unknown: Cas14 sequence"
MSDESLVSSEDKLAIKIKIVPNAEQAKMLDEMFKKWSSICNRISRGKEDIETLRPDEGKELQFNSTQLNSATMDVSDLKKAMARQGERLEAEVSKLRGRYETIDASLRDPSRRHTNPQKPSSFYPSDWDISGRLTPRFHTARHYSTELRKLKAKEDKMLKTINKIKNGKIVFKPKRITLWPSSVNMAFKGSRLLLKPFANGFEMELPIVISPQKTADGKSQKASAEYMRNALLGLAGYSINQLLFGMNRSQKMLANAKKPEKVEKFLEQMKNKDANFDKKIKALEGKWLLDRKLKESEKSSIAVVRTKFFKSGKVELNEDYLKLLKHMANEILERDGFVNLNKYPILSRKPMKRYKQKNIDNLKPNMWKYYIQFGYEPIFERKASGKPKNIMGIDRGLTHLLAVAVFSPDQQKFLFNHLESNPIMHWKWKLRKIRRSIQHMERRIRAEKNKHIHEAQLKKRLGSIEEKTEQHYHIVSSKIINWAIEYEAAIVLESLSHMKQRGGKKSVRTRALNYALSLFDYEKVARLITYKARIRGIPVYDVLPGMTSKTCATCLLNGSQGAYVRGLETTKAAGKATKRKNMKIGKCMVCNSSENSMIDADLNAARVIAICKYKNLNDPQPAGSRKVFKRF

SEQ ID NO: 36 - protein, 625 aa, Unknown
  source: /note="Description of Unknown: Cas14 sequence"
MLALKLKIMPTEKQAEILDAMFWKWASICSRIAKMKKKVSVKENKKELSKKIPSNSDIWFSKTQLCQAEVDVGDHKKALKNFEKRQESLLDELKYKVKAINEVINDESKREIDPNNPSKFRIKDSTKKGNLNSPKFFTLKKWQKILQENEKRIKKKESTIEKLKRGNIFFNPTKISLHEEEYSINFGSSKLLLNCFYKYNKKSGINSDQLENKFNEFQNGLNIICSPLQPIRGSSKRSFEFIRNSIINFLMYSLYAKLFGIPRSVKALMKSNKDENKLKLEEKLKKKKSSFNKTVKEFEKMIGRKLSDNESKILNDESKKFFEIIKSNNKYIPSEEYLKLLKDISEEIYNSNIDFKPYKYSILIRKPLSKFKSKKLYNLKPTDYKYYLQLSYEPFSKQLIATKTILGIDRGLKHLLAVSVFDPSQNKFVYNKLIKNPVFKWKKRYHDLKRSIRNRERRIRALTGVHIHENQLIKKLKSMKNKINVLYHNVSKNIVDLAKKYESTIVLERLENLKQHGRSKGKRYKKLNYVLSNFDYKKIESLISYKAKKEGVPVSNINPKYTSKTCAKCLLEVNQLSELKNEYNRDSKNSKIGICNIHGQIDADLNAARVIALCYSKNLNEPHFK

SEQ ID NO: 37 - protein, 517 aa, Unknown
  source: /note="Description of Unknown: Cas14 sequence"
VINLFGYKFALYPNKTQEELLNKHLGECGWLYNKAIEQNEYYKADSNIEEAQKKFELLPDKNSDEAKVLRGNISKDNYVYRTLVKKKKSEINVQIRKAVVLRPAETIRNLAKVKKKGLSVGRLKFIPIREWDVLPFKQSDQIRLEENYLILEPYGRLKFKMHRPLLGKPKTFCIKRTATDRWTISFSTEYDDSNMRKNDGGQVGIDVGLKTHLRLSNENPDEDPRYPNPKIWKRYDRRLTILQRRISKSKKLGKNRTRLRLRLSRLWEKIRNSRADLIQNETYEILSENKLIAIEDLNVKGMQEKKDKKGRKGRTRAQEKGLHRSISDAAFSEFRRVLEYKAKRFGSEVKPVSAIDSSKECHNCGNKKGMPLESRIYECPKCGLKIDRDLNSAKVILARATGVRPGSNARADTKISATAGASVQTEGTVSEDFRQQMETSDQKPMQGEGSKEPPMNPEHKSSGRGSKHVNIGCKNKVGLYNEDENSRSTEKQIMDENRSTTEDMVEIGALHSPVLTT

SEQ ID NO: 38 - protein, 410 aa, Unknown
  source: /note="Description of Unknown: Cas14 sequence"
MIASIDYEAVSQALIVFEFKAKGKDSQYQAIDEAIRSYRFIRNSCLRYWMDNKKVGKYDLNKYCKVLAKQYPFANKLNSQARQSAAECSWSAISRFYDNCKRKVSGKKGFPKFKKHARSVEYKTSGWKLSENRKAITFTDKNGIGKLKLKGTYDLHFSQLEDMKRVRLVRRADGYYVQFCISVDVKVETEPTGKAIGLDVGIKYFLADSSGNTIENPQFYRKAEKKLNRANRRKSKKYIRGVKPQSKNYHKARCRYARKHLRVSRQRKEYCKRVAYCVIHSNDVVAYEDLNVKGMVKNRHLAKSISDVAWSTFRHWLEYFAIKYGKLTIPVAPHNTSQNCSNCDKKVPKSLSTRTHICHHCGYSEDRDVNAAKNILKKALSTVGQTGSLKLGEIEPLLVLEQSCTRKFDL

SEQ ID NO: 39 - protein, 486 aa, Unknown
  source: /note="Description of Unknown: Cas14 sequence"
LAEENTLHLTLAMSLPLNDLPENRTRSELWRRQWLPQKKLSLLLGVNQSVRKAAADCLRWFEPYQELLWWEPTDPDGKKLLDKEGRPIKRTAGHMRVLRKLEEIAPFRGYQLGSAVKNGLRHKVADLLLSYAKRKLDPQFTDKTSYPSIGDQFPIVWTGAFVCYEQSITGQLYLYLPLFPRGSHQEDITNNYDPDRGPALQVFGEKEIARLSRSTSGLLLPLQFDKWGEATFIRGENNPPTWKATHRRSDKKWLSEVLLREKDFQPKRVELLVRNGRIFVNVACEIPTKPLLEVENFMGVSFGLEHLVTVVVINRDGNVVHQRQEPARRYEKTYFARLERLRRRGGPFSQELETFHYRQVAQIVEEALRFKSVPAVEQVGNIPKGRYNPRLNLRLSYWPFGKLADLTSYKAVKEGLPKPYSVYSATAKMLCSTCGAANKEGDQPISLKGPTVYCGNCGTRHNTGFNTALNLARRAQELFVKGVVAR

SEQ ID NO: 40 - protein, 602 aa, Unknown
  source: /note="Description of Unknown: Cas14 sequence"
MSQSLLKWHDMAGRDKDASRSLQKSAVEGVLLHLTASHRVALEMLEKSVSQTVAVTMEAAQQRLVIVLEDDPTKATSRKRVISADLQFTREEFGSLPNWAQKLASTCPEIATKYADKHINSIRIAWGVAKESTNGDAVEQKLQWQIRLLDVTMFLQQLVLQLADKALLEQIPSSIRGGIGQEVAQQVTSHIQLLDSGTVLKAELPTISDRNSELARKQWEDAIQTVCTYALPFSRERARILDPGKYAAEDPRGDRLINIDPMWARVLKGPTVKSLPLLFVSGSSIRIVKLTLPRKHAAGHKHTFTATYLVLPVSREWINSLPGTVQEKVQWWKKPDVLATQELLVGKGALKKSANTLVIPISAGKKRFFNHILPALQRGFPLQWQRIVGRSYRRPATHRKWFAQLTIGYTNPSSLPEMALGIHFGMKDILWWALADKQGNILKDGSIPGNSILDFSLQEKGKIERQQKAGKNVAGKKYGKSLLNATYRVVNGVLEFSKGISAEHASQPIGLGLETIRFVDKASGSSPVNARHSNWNYGQLSGIFANKAGPAGFSVTEITLKKAQRDLSDAEQARVLAIEATKRFASRIKRLATKRKDDTLFV

SEQ ID NO: 41 - protein, 494 aa, Unknown
  source: /note="Description of Unknown: Cas14 sequence"
VEPVEKERFYYRTYTFRLDGQPRTQNLTTQSGWGLLTKAVLDNTKHYWEIVHHARIANQPIVFENPVIDEQGNPKLNKLGQPRFWKRPISDIVNQLRALFENQNPYQLGSSLIQGTYWDVAENLASWYALNKEYLAGTATWGEPSFPEPHPLTEINQWMPLTFSSGKVVRLLKNASGRYFIGLPILGENNPCYRMRTIEKLIPCDGKGRVTSGSLILFPLVGIYAQQHRRMTDICESIRTEKGKLAWAQVSIDYVREVDKRRRMRRTRKSQGWIQGPWQEVFILRLVLAHKAPKLYKPRCFAGISLGPKTLASCVILDQDERVVEKQQWSGSELLSLIHQGEERLRSLREQSKPTWNAAYRKQLKSLINTQVFTIVTFLRERGAAVRLESIARVRKSTPAPPVNFLLSHWAYRQITERLKDLAIRNGMPLTHSNGSYGVRFTCSQCGATNQGIKDPTKYKVDIESETFLCSICSHREIAAVNTATNLAKQLLDE

SEQ ID NO: 42 - protein, 526 aa, Unknown
  source: /note="Description of Unknown: Cas14 sequence"
MNDTETSETLTSHRTVCAHLHVVGETGSLPRLVEAALAELITLNGRATQALLSLAKNGLVLRRDKEENLIAAELTLPCRKNKYADVAAKAGEPILATRINNKGKLVTKKWYGEGNSYHIVRFTPETGMFTVRVFDRYAFDEELLHLHSEVVFGSDLPKGIKAKTDSLPANFLQAVFTSFLELPFQGFPDIVVKPAMKQAAEQLLSYVQLEAGENQQAEYPDTNERDPELRLVEWQKSLHELSVRTEPFEFVRARDIDYYAETDRRGNRFVNITPEWTKFAESPFARRLPLKIPPEFCILLRRKTEGHAKIPNRIYLGLQIFDGVTPDSTLGVLATAEDGKLFWWHDHLDEFSNLEGKPEPKLKNKPQLLMVSLEYDREQRFEESVGGDRKICLVTLKETRNFRRGWNGRILGIHFQHNPVITWALMDHDAEVLEKGFIEGNAFLGKALDKQALNEYLQKGGKWVGDRSFGNKLKGITHTLASLIVRLAREKDAWIALEEISWVQKQSADSVANHEIVEQPHHSLTR

SEQ ID NO: 43 - protein, 649 aa, Unknown
  source: /note="Description of Unknown: Cas14 sequence"
MNDTETSETLTSHRTVCAHLHVVGETGSLPRLVEAALAELITLNGRATQALLSLAKNGLVLRRDKEENLIAAELTLPCRKNKYADVAAKAGEPILATRINNKGKLVTKKWYGEGNSYHIVRFTPETGMFTVRVFDRYAFDEELLHLHSEVVFGSDLPKGIKAKTDSLPANFLQAVFTSFLELPFQGFPDIVVKPAMKQAAEQLLSYVQLEAGENQQAEYPDTNERDPELRLVEWQKSLHELSVRTEPFEFVRARDIDYYAETDRRGNRFVNITPEWTKFAESPFARRLPLKIPPEFCILLRRKTEGHAKIPNRIYLGLQIFDGVTPDSTLGVLATAEDGKLFWWHDHLDEFSNLEGKPEPKLKNKPQLLMVSLEYDREQRFEESVGGDRKICLVTLKETRNFRRGRHGHTRTDRLPAGNTLWRADFATSAEVAAPKWNGRILGIHFQHNPVITWALMDHDAEVLEKGFIEGNAFLGKALDKQALNEYLQKGGKWVGDRSFGNKLKGITHTLASLIVRLAREKDAWIALEEISWVQKQSADSVANRRFSMWNYSRLATLIEWLGTDIATRDCGTAAPLAHKVSDYLTHFTCPECGACRKAGQKKEIADTVRAGDILTCRKCGFSGPIPDNFIAEFVAKKALERMLKKKPV

SEQ ID NO: 44 - protein, 414 aa, Unknown
  source: /note="Description of Unknown: Cas14 sequence"
MAKRNFGEKSEALYRAVRFEVRPSKEELSILLAVSEVLRMLFNSALAERQQVFTEFIASLYAELKSASVPEEISEIRKKLREAYKEHSISLFDQINALTARRVEDEAFASVTRNWQEETLDALDGAYKSFLSLRRKGDYDAHSPRSRDSGFFQKIPGRSGFKIGEGRIALSCGAGRKLSFPIPDYQQGRLAETTKLKKFELYRDQPNLAKSGRFWISVVYELPKPEATTCQSEQVAFVALGASSIGVVSQRGEEVIALWRSDKHWVPKIEAVEERMKRRVKGSRGWLRLLNSGKRRMHMISSRQHVQDEREIVDYLVRNHGSHFVVTELVVRSKEGKLADSSKPERGGSLGLNWAAQNTGSLSRLVRQLEEKVKEHGGSVRKHKLTLTEAPPARGAENKLWMARKLRESFLKEV

SEQ ID NO: 45 - protein, 413 aa, Unknown
  source: /note="Description of Unknown: Cas14 sequence"
LAKNDEKELLYQSVKFEIYPDESKIRVLTRVSNILVLVWNSALGERRARFELYIAPLYEELKKFPRKSAESNALRQKIREGYKEHIPTFFDQLKKLLTPMRKEDPALLGSVPRAYQEETLNTLNGSFVSFMTLRRNNDMDAKPPKGRAEDRFHEISGRSGFKIDGSEFVLSTKEQKLRFPIPNYQLEKLKEAKQIKKFTLYQSRDRRFWISIAYEIELPDQRPFNPEEVIYIAFGASSIGVISPEGEKVIDFWRPDKHWKPKIKEVENRMRSCKKGSRAWKKRAAARRKMYAMTQRQQKLNHREIVASLLRLGFHFVVTEYTVRSKPGKLADGSNPKRGGAPQGFNWSAQNTGSFGEFILWLKQKVKEQGGTVQTFRLVLGQSERPEKRGRDNKIEMVRLLREKYLESQTIVV

SEQ ID NO: 46 - protein, 449 aa, Unknown
  source: /note="Description of Unknown: Cas14 sequence"
MAKGKKKEGKPLYRAVRFEIFPTSDQITLFLRVSKNLQQVWNEAWQERQSCYEQFFGSIYERIGQAKKRAQEAGFSEVWENEAKKGLNKKLRQQEISMQLVSEKESLLQELSIAFQEHGVTLYDQINGLTARRIIGEFALIPRNWQEETLDSLDGSFKSFLALRKNGDPDAKPPRQRVSENSFYKIPGRSGFKVSNGQIYLSFGKIGQTLTSVIPEFQLKRLETAIKLKKFELCRDERDMAKPGRFWISVAYEIPKPEKVPVVSKQITYLAIGASRLGVVSPKGEFCLNLPRSDYHWKPQINALQERLEGVVKGSRKWKKRMAACTRMFAKLGHQQKQHGQYEVVKKLLRHGVHFVVTELKVRSKPGALADASKSDRKGSPTGPNWSAQNTGNIARLIQKLTDKASEHGGTVIKRNPPLLSLEERQLPDAQRKIFIAKKLREEFLADQK

SEQ ID NO: 47 - protein, 711 aa, Unknown
  source: /note="Description of Unknown: Cas14 sequence"
MAKREKKDDVVLRGTKMRIYPTDRQVTLMDMWRRRCISLWNLLLNLETAAYGAKNTRSKLGWRSIWARVVEENHAKALIVYQHGKCKKDGSFVLKRDGTVKHPPRERFPGDRKILLGLFDALRHTLDKGAKCKCNVNQPYALTRAWLDETGHGARTADIIAWLKDFKGECDCTAISTAAKYCPAPPTAELLTKIKRAAPADDLPVDQAILLDLFGALRGGLKQKECDHTHARTVAYFEKHELAGRAEDILAWLIAHGGTCDCKIVEEAANHCPGPRLFIWEHELAMIMARLKAEPRTEWIGDLPSHAAQTVVKDLVKALQTMLKERAKAAAGDESARKTGFPKFKKQAYAAGSVYFPNTTMFFDVAAGRVQLPNGCGSMRCEIPRQLVAELLERNLKPGLVIGAQLGLLGGRIWRQGDRWYLSCQWERPQPTLLPKTGRTAGVKIAASIVFTTYDNRGQTKEYPMPPADKKLTAVHLVAGKQNSRALEAQKEKEKKLKARKERLRLGKLEKGHDPNALKPLKRPRVRRSKLFYKSAARLAACEAIERDRRDGFLHRVTNEIVHKFDAVSVQKMSVAPMMRRQKQKEKQIESKKNEAKKEDNGAAKKPRNLKPVRKLLRHVAMARGRQFLEYKYNDLRGPGSVLIADRLEPEVQECSRCGTKNPQMKDGRRLLRCIGVLPDGTDCDAVLPRNRNAARNAEKRLRKHREAHNA

SEQ ID NO: 48 - protein, 574 aa, Unknown
  source: /note="Description of Unknown: Cas14 sequence"
MNEVLPIPAVGEDAADTIMRGSKMRIYPSVRQAATMDLWRRRCIQLWNLLLELEQAAYSGENRRTQIGWRSIWATVVEDSHAEAVRVAREGKKRKDGTFRKAPSGKEIPPLDPAMLAKIQRQMNGAVDVDPKTGEVTPAQPRLFMWEHELQKIMARLKQAPRTHWIDDLPSHAAQSVVKDLIKALQAMLRERKKRASGIGGRDTGFPKFKKNRYAAGSVYFANTQLRFEAKRGKAGDPDAVRGEFARVKLPNGVGWMECRMPRHINAAHAYAQATLMGGRIWRQGENWYLSCQWKMPKPAPLPRAGRTAAIKIAAAIPITTVDNRGQTREYAMPPIDRERIAAHAAAGRAQSRALEARKRRAKKREAYAKKRHAKKLERGIAAKPPGRARIKLSPGFYAAAAKLAKLEAEDANAREAWLHEITTQIVRNFDVIAVPRMEVAKLMKKPEPPEEKEEQVKAPWQGKRRSLKAARVMMRRTAMALIQTTLKYKAVDLRGPQAYEEIAPLDVTAAACSGCGVLKPEWKMARAKGREIMRCQEPLPGGKTCNTVLTYTRNSARVIGRELAVRLAERQKA

SEQ ID NO: 49 - protein, 400 aa, Unknown
  source: /note="Description of Unknown: Cas14 sequence"
MTTQKTYNFCFYDQRFFELSKEAGEVYSRSLEEFWKIYDETGVWLSKFDLQKHMRNKLERKLLHSDSFLGAMQQVHANLASWKQAKKVVPDACPPRKPKFLQAILFKKSQIKYKNGFLRLTLGTEKEFLYLKWDINIPLPIYGSVTYSKTRGWKINLCLETEVEQKNLSENKYLSIDLGVKRVATIFDGENTITLSGKKFMGLMHYRNKLNGKTQSRLSHKKKGSNNYKKIQRAKRKTTDRLLNIQKEMLHKYSSFIVNYAIRNDIGNIIIGDNSSTHDSPNMRGKTNQKISQNPEQKLKNYIKYKFESISGRVDIVPEPYTSRKCPHCKNIKKSSPKGRTYKCKKCGFIFDRDGVGAINIYNENVSFGQIISPGRIRSLTEPIGMKFHNEIYFKSYVAA

SEQ ID NO: 50 - protein, 743 aa, Unknown
  source: /note="Description of Unknown: Cas14 sequence"
MSVRSFQARVECDKQTMEHLWRTHKVFNERLPEIIKILFKMKRGECGQNDKQKSLYKSISQSILEANAQNADYLLNSVSIKGWKPGTAKKYRNASFTWADDAAKLSSQGIHVYDKKQVLGDLPGMMSQMVCRQSVEAISGHIELTKKWEKEHNEWLKEKEKWESEDEHKKYLDLREKFEQFEQSIGGKITKRRGRWHLYLKWLSDNPDFAAWRGNKAVINPLSEKAQIRINKAKPNKKNSVERDEFFKANPEMKALDNLHGYYERNFVRRRKTKKNPDGFDHKPTFTLPHPTIHPRWFVFNKPKTNPEGYRKLILPKKAGDLGSLEMRLLTGEKNKGNYPDDWISVKFKADPRLSLIRPVKGRRVVRKGKEQGQTKETDSYEFFDKHLKKWRPAKLSGVKLIFPDKTPKAAYLYFTCDIPDEPLTETAKKIQWLETGDVTKKGKKRKKKVLPHGLVSCAVDLSMRRGTTGFATLCRYENGKIHILRSRNLWVGYKEGKGCHPYRWTEGPDLGHIAKHKREIRILRSKRGKPVKGEESHIDLQKHIDYMGEDRFKKAARTIVNFALNTENAASKNGFYPRADVLLLENLEGLIPDAEKERGINRALAGWNRRHLVERVIEMAKDAGFKRRVFEIPPYGTSQVCSKCGALGRRYSIIRENNRREIRFGYVEKLFACPNCGYCANADHNASVNLNRRFLIEDSFKSYYDWKRLSEKKQKEEIETIESKLMDKLCAMHKISRGSISK

SEQ ID NO: 51 - protein, 769 aa, Unknown
  source: /note="Description of Unknown: Cas14 sequence"
MHLWRTHCVFNQRLPALLKRLFAMRRGEVGGNEAQRQVYQRVAQFVLARDAKDSVDLLNAVSLRKRSANSAFKKKATISCNGQAREVTGEEVFAEAVALASKGVFAYDKDDMRAGLPDSLFQPLTRDAVACMRSHEELVATWKKEYREWRDRKSEWEAEPEHALYLNLRPKFEEGEAARGGRFRKRAERDHAYLDWLEANPQLAAWRRKAPPAVVPIDEAGKRRIARAKAWKQASVRAEEFWKRNPELHALHKIHVQYLREFVRPRRTRRNKRREGFKQRPTFTMPDPVRHPRWCLFNAPQTSPQGYRLLRLPQSRRTVGSVELRLLTGPSDGAGFPDAWVNVRFKADPRLAQLRPVKVPRTVTRGKNKGAKVEADGFRYYDDQLLIERDAQVSGVKLLFRDIRMAPFADKPIEDRLLSATPYLVFAVEIKDEARTERAKAIRFDETSELTKSGKKRKTLPAGLVSVAVDLDTRGVGFLTRAVIGVPEIQQTHHGVRLLQSRYVAVGQVEARASGEAEWSPGPDLAHIARHKREIRRLRQLRGKPVKGERSHVRLQAHIDRMGEDRFKKAARKIVNEALRGSNPAAGDPYTRADVLLYESLETLLPDAERERGINRALLRWNRAKLIEHLKRMCDDAGIRHFPVSPFGTSQVCSKCGALGRRYSLARENGRAVIRFGWVERLFACPNPECPGRRPDRPDRPFTCNSDHNASVNLHRVFALGDQAVAAFRALAPRDSPARTLAVKRVEDTLRPQLMRVHKLADAGVDSPF

SEQ ID NO: 52 - protein, 666 aa, Unknown
  source: /note="Description of Unknown: Cas14 sequence"
MATLVYRYGVRAHGSARQQDAVVSDPAMLEQLRLGHELRNALVGVQHRYEDGKRAVWSGFASVAAADHRVTTGETAVAELEKQARAEHSADRTAATRQGTAESLKAARAAVKQARADRKAAMAAVAEQAKPKIQALGDDRDAEIKDLYRRFCQDGVLLPRCGRCAGDLRSDGDCTDCGAAHEPRKLYWATYNAIREDHQTAVKLVEAKRKAGQPARLRFRRWTGDGTLTVQLQRMHGPACRCVTCAEKLTRRARKTDPQAPAVAADPAYPPTDPPRDPALLASGQGKWRNVLQLGTWIPPGEWSAMSRAERRRVGRSHIGWQLGGGRQLTLPVQLHRQMPADADVAMAQLTRVRVGGRHRMSVALTAKLPDPPQVQGLPPVALHLGWRQRPDGSLRVATWACPQPLDLPPAVADVVVSHGGRWGEVIMPARWLADAEVPPRLLGRRDKAMEPVLEALADWLEAHTEACTARMTPALVRRWRSQGRLAGLTNRWRGQPPTGSAEILTYLEAWRIQDKLLWERESHLRRRLAARRDDAWRRVASWLARHAGVLVVDDADIAELRRRDDPADTDPTMPASAAQAARARAALAAPGRLRHLATITATRDGLGVHTVASAGLTRLHRKCGHQAQPDPRYAASAVVTCPGCGNGYDQDYNAAMLMLDRQQQP

SEQ ID NO: 53 - protein, 564 aa, Unknown
  source: /note="Description of Unknown: Cas14 sequence"
MSRVELHRAYKFRLYPTPAQVAELAEWERQLRRLYNLAHSQRLAAMQRHVRPKSPGVLKSECLSCGAVAVAEIGTDGKAKKTVKHAVGCSVLECRSCGGSPDAEGRTAHTAACSFVDYYRQGREMTQLLEEDDQLARVVCSARQETLRDLEKAWQRWHKMPGFGKPHFKKRIDSCRIYFSTPKSWAVDLGYLSFTGVASSVGRIKIRQDRVWPGDAKFSSCHVVRDVDEWYAVFPLTFTKEIEKPKGGAVGINRGAVHAIADSTGRVVDSPKFYARSLGVIRHRARLLDRKVPFGRAVKPSPTKYHGLPKADIDAAAARVNASPGRLVYEARARGSIAAAEAHLAALVLPAPRQTSQLPSEGRNRERARRFLALAHQRVRRQREWFLHNESAHYAQSYTKIAIEDWSTKEMTSSEPRDAEEMKRVTRARNRSILDVGWYELGRQIAYKSEATGAEFAKVDPGLRETETHVPEAIVRERDVDVSGMLRGEAGISGTCSRCGGLLRASASGHADAECEVCLHVEVGDVNAAVNVLKRAMFPGAAPPSKEKAKVTIGIKGRKKKRAA

SEQ ID NO: 54 - protein, 565 aa, Unknown
  source: /note="Description of Unknown: Cas14 sequence"
MSRVELHRAYKFRLYPTPVQVAELSEWERQLRRLYNLGHEQRLLTLTRHLRPKSPGVLKGECLSCDSTQVQEVGADGRPKTTVRHAEQCPTLACRSCGALRDAEGRTAHTVACAFVDYYRQGREMTELLAADDQLARVVCSARQEVLRDLDKAWQRWRKMPGFGKPRFKRRTDSCRIYFSTPKAWKLEGGHLSFTGAATTVGAIKMRQDRNWPASVQFSSCHVVRDVDEWYAVFPLTFVAEVARPKGGAVGINRGAVHAIADSTGRVVDSPRYYARALGVIRHRARLFDRKVPSGHAVKPSPTKYRGLSAIEVDRVARATGFTPGRVVTEALNRGGVAYAECALAAIAVLGHGPERPLTSDGRNREKARKFLALAHQRVRRQREWFLHNESAHYARTYSKIAIEDWSTKEMTASEPQGEETRRVTRSRNRSILDVGWYELGRQLAYKTEATGAEFAQVDPGLKETETNVPKAIADARDVDVSGMLRGEAGISGTCSKCGGLLRAPASGHADAECEICLNVEVGDVNAAVNVLKRAMFPGDAPPASGEKPKVSIGIKGRQKKKKAA

SEQ ID NO: 55 - protein, 499 aa, Unknown
  source: /note="Description of Unknown: Cas14 sequence"
MEAIATGMSPERRVELGILPGSVELKRAYKFRLYPMKVQQAELSEWERQLRRLYNLAHEQRLAALLRYRDWDFQKGACPSCRVAVPGVHTAACDHVDYFRQAREMTQLLEVDAQLSRVICCARQEVLRDLDKAWQRWRKKLGGRPRFKRRTDSCRIYLSTPKHWEIAGRYLRLSGLASSVGEIRIEQDRAFPEGALLSSCSIVRDVDEWYACLPLTFTQPIERAPHRSVGLNRGVVHALADSDGRVVDSPKFFERALATVQKRSRDLARKVSGSRNAHKARIKLAKAHQRVRRQRAAFLHQESAYYSKGFDLVALEDMSVRKMTATAGEAPEMGRGAQRDLNRGILDVGWYELARQIDYKRLAHGGELLRVDPGQTTPLACVTEEQPARGISSACAVCGIPLARPASGNARMRCTACGSSQVGDVNAAENVLTRALSSAPSGPKSPKASIKIKGRQKRLGTPANRAGEASGGDPPVRGPVEGGTLAYVVEPVSESQSDT

SEQ ID NO: 56 - protein, 560 aa, Unknown
  source: /note="Description of Unknown: Cas14 sequence"
MTVRTYKYRAYPTPEQAEALTSWLRFASQLYNAALEHRKNAWGRHDAHGRGFRFWDGDAAPRKKSDPPGRWVYRGGGGAHISKNDQGKLLTEFRREHAELLPPGMPALVQHEVLARLERSMAAFFQRATKGQKAGYPRWRSEHRYDSLTFGLTSPSKERFDPETGESLGRGKTVGAGTYHNGDLRLTGLGELRILEHRRIPMGAIPKSVIVRRSGKRWFVSIAMEMPSVEPAASGRPAVGLDMGVVTWGTAFTADTSAAAALVADLRRMATDPSDCRRLEELEREAAQLSEVLAHCRARGLDPARPRRCPKELTKLYRRSLHRLGELDRACARIRRRLQAAHDIAEPVPDEAGSAVLIEGSNAGMRHARRVARTQRRVARRTRAGHAHSNRRKKAVQAYARAKERERSARGDHRHKVSRALVRQFEEISVEALDIKQLTVAPEHNPDPQPDLPAHVQRRRNRGELDAAWGAFFAALDYKAADAGGRVARKPAPHTTQECARCGTLVPKPISLRVHRCPACGYTAPRTVNSARNVLQRPLEEPGRAGPSGANGRGVPHAVA

SEQ ID NO: 57 - protein, 404 aa, Unknown
  source: /note="Description of Unknown: Cas14 sequence"
MNCRYRYRIYPTPGQRQSLARLFGCVRVVWNDALFLCRQSEKLPKNSELQKLCITQAKKTEARGWLGQVSAIPLQQSVADLGVAFKNFFQSRSGKRKGKKVNPPRVKRRNNRQGARFTRGGFKVKTSKVYLARIGDIKIKWSRPLPSEPSSVTVIKDCAGQYFLSFVVEVKPEIKPPKNPSIGIDLGLKTFASCSNGEKIDSPDYSRLYRKLKRCQRRLAKRQRGSKRRERMRVKVAKLNAQIRDKRKDFLHKLSTKVVNENQVIALEDLNVGGMLKNRKLSRAISQAGWYEFRSLCEGKAEKHNRDFRVISRWEPTSQVCSECGYRWGKIDLSVRSIVCINCGVEHDRDDNASVNIEQAGLKVGVGHTHDSKRTGSACKTSNGAVCVEPSTHREYVQLTLFDW

SEQ ID NO: 58 - protein, 392 aa, Unknown
  source: /note="Description of Unknown: Cas14 sequence"
MKSRWTFRCYPTPEQEQHLARTFGCVRFVWNWALRARTDAFRAGERIGYPATDKALTLLKQQPETVWLNEVSSVCLQQALRDLQVAFSNFFDKRAAHPSFKRKEARQSANYTERGFSFDHERRILKLAKIGAIKVKWSRKAIPHPSSIRLIRTASGKYFVSLVVETQPAPMPETGESVGVDFGVARLATLSNGERISNPKHGAKWQRRLAFYQKRLARATKGSKRRMRIKRHVARIHEKIGNSRSDTLHKLSTDLVTRFDLICVEDLNLRGMVKNHSLARSLHDASIGSAIRMIEEKAERYGKNVVKIDRWFPSSKTCSDCGHIVEQLPLNVREWTCPECGTTHDRDANAAANILAVGQTVSAHGGTVRRSRAKASERKSQRSANRQGVNRA

SEQ ID NO: 59 - protein, 500 aa, Unknown
  source: /note="Description of Unknown: Cas14 sequence"
KEPLNIGKTAKAVFKEIDPTSLNRAANYDASIELNCKECKFKPFKNVKRYEFNFYNNWYRCNPNSCLQSTYKAQVRKVEIGYEKLKNEILTQMQYYPWFGRLYQNFFHDERDKMTSLDEIQVIGVQNKVFFNTVEKAWREIIKKRFKDNKETMETIPELKHAAGHGKRKLSNKSLLRRRFAFVQKSFKFVDNSDVSYRSFSNNIACVLPSRIGVDLGGVISRNPKREYIPQEISFNAFWKQHEGLKKGRNIEIQSVQYKGETVKRIEADTGEDKAWGKNRQRRFTSLILKLVPKQGGKKVWKYPEKRNEGNYEYFPIPIEFILDSGETSIRFGGDEGEAGKQKHLVIPFNDSKATPLASQQTLLENSRFNAEVKSCIGLAIYANYFYGYARNYVISSIYHKNSKNGQAITAIYLESIAHNYVKAIERQLQNLLLNLRDFSFMESHKKELKKYFGGDLEGTGGAQKRREKEEKIEKEIEQSYLPRLIRLSLTKMVTKQVEM

SEQ ID NO: 60 - protein, 507 aa, Unknown
  source: /note="Description of Unknown: Cas14 sequence"
ELIVNENKDPLNIGKTAKAVFKEIDPTSINRAANYDASIELACKECKFKPFNNTKRHDFSFYSNWHRCSPNSCLQSTYRAKIRKTEIGYEKLKNEILNQMQYYPWFGRLYQNFFNDQRDKMTSLDEIQVTGVQNKIFFNTVEKAWREIIKKRFRDNKETMRTIPDLKNKSGHGSRKLSNKSLLRRRFAFAQKSFKLVDNSDVSYRAFSNNVACVLPSKIGVDIGGIINKDLKREYIPQEITFNVFWKQHDGLKKGRNIEIHSVQYKGEIVKRIEADTGEDKAWGKNRQRRFTSLILKITPKQGGKKIWKFPEKKNASDYEYFPIPIEFILDNGDASIKFGGEEGEVGKQKHLLIPFNDSKATPLSSKQMLLETSRFNAEVKSTIGLALYANYFVSYARNYVIKSTYHKNSKKGQIVTEIYLESISQNFVRAIQRQLQSLMLNLKDWGFMQTHKKELKKYFGSDLEGSKGGQKRREKEEKIEKEIEASYLPRLIRLSLTKSVTKAEEM

SEQ ID NO: 61 - protein, 529 aa, Unknown
  source: /note="Description of Unknown: Cas14 sequence"
PEEKTSKLKPNSINLAANYDANEKFNCKECKFHPFKNKKRYEFNFYNNLHGCKSCTKSTNNPAVKRIEIGYQKLKFEIKNQMEAYPWFGRLRINFYSDEKRKMSELNEMQVTGVKNKIFFDAIECAWREILKKRFRESKETLITIPKLKNKAGHGARKHRNKKLLIRRRAFMKKNFHFLDNDSISYRSFANNIACVLPSKVGVDIGGIISPDVGKDIKPVDISLNLMWASKEGIKSGRKVEIYSTQYDGNMVKKIEAETGEDKSWGKNRKRRQTSLLLSIPKPSKQVQEFDFKEWPRYKDIEKKVQWRGFPIKIIFDSNHNSIEFGTYQGGKQKVLPIPFNDSKTTPLGSKMNKLEKLRFNSKIKSRLGSAIAANKFLEAARTYCVDSLYHEVSSANAIGKGKIFIEYYLEILSQNYIEAAQKQLQRFIESIEQWFVADPFQGRLKQYFKDDLKRAKCFLCANREVQTTCYAAVKLHKSCAEKVKDKNKELAIKERNNKEDAVIKEVEASNYPRVIRLKLTKTITNKAM

SEQ ID NO: 62 - protein, 726 aa, Unknown
  source: /note="Description of Unknown: Cas14 sequence"
SESENKIIEQYYAFLYSFRDKYEKPEFKNRGDIKRKLQNKWEDFLKEQNLKNDKKLSNYIFSNRNFRRSYDREEENEEGIDEKKSKPKRINCFEKEKNLKDQYDKDAINASANKDGAQKWGCFECIFFPMYKIESGDPNKRIIINKTRFKLFDFYLNLKGCKSCLRSTYHPYRSNVYIESNYDKLKREIGNFLQQKNIFQRMRKAKVSEGKYLTNLDEYRLSCVAMHFKNRWLFFDSIQKVLRETIKQRLKQMRESYDEQAKTKRSKGHGRAKYEDQVRMIRRRAYSAQAHKLLDNGYITLFDYDDKEINKVCLTAINQEGFDIGGYLNSDIDNVMPPIEISFHLKWKYNEPILNIESPFSKAKISDYLRKIREDLNLERGKEGKARSKKNVRRKVLASKGEDGYKKIFTDFFSKWKEELEGNAMERVLSQSSGDIQWSKKKRIHYTTLVLNINLLDKKGVGNLKYYEIAEKTKILSFDKNENKFWPITIQVLLDGYEIGTEYDEIKQLNEKTSKQFTIYDPNTKIIKIPFTDSKAVPLGMLGINIATLKTVKKTERDIKVSKIFKGGLNSKIVSKIGKGIYAGYFPTVDKEILEEVEEDTLDNEFSSKSQRNIFLKSIIKNYDKMLKEQLFDFYSFLVRNDLGVRFLTDRELQNIEDESFNLEKRFFETDRDRIARWFDNTNTDDGKEKFKKLANEIVDSYKPRLIRLPVVRVIKRIQPVKQREM

SEQ ID NO: 63 - protein, 517 aa, Unknown
  source: /note="Description of Unknown: Cas14 sequence"
KYSTRDFSELNEIQVTACKQDEFFKVIQNAWREIIKKRFLENRENFIEKKIFKNKKGRGKRQESDKTIQRNRASVMKNFQLIENEKIILRAPSGHVACVFPVKVGLDIGGFKTDDLEKNIFPPRTITINVFWKNRDRQRKGRKLEVWGIKARTKLIEKVHKWDKLEEVKKKRLKSLEQKQEKSLDNWSEVNNDSFYKVQIDELQEKIDKSLKGRTMNKILDNKAKESKEAEGLYIEWEKDFEGEMLRRIEASTGGEEKWGKRRQRRHTSLLLDIKNNSRGSKEIINFYSYAKQGKKEKKIEFFPFPLTITLDAEEESPLNIKSIPIEDKNATSKYFSIPFTETRATPLSILGDRVQKFKTKNISGAIKRNLGSSISSCKIVQNAETSAKSILSLPNVKEDNNMEIFINTMSKNYFRAMMKQMESFIFEMEPKTLIDPYKEKAIKWFEVAASSRAKRKLKKLSKADIKKSELLLSNTEEFEKEKQEKLEALEKEIEEFYLPRIVRLQLTKTILETPVM

SEQ ID NO: 64 - protein, 481 aa, Unknown
  source: /note="Description of Unknown: Cas14 sequence"
KKLQLLGHKILLKEYDPNAVNAAANFETSTAELCGQCKMKPFKNKRRFQYTFGKNYHGCLSCIQNVYYAKKRIVQIAKEELKHQLTDSIASIPYKYTSLFSNTNSIDELYILKQERAAFFSNTNSIDELYITGIENNIAFKVISAIWDEIIKKRRQRYAESLTDTGTVKANRGHGGTAYKSNTRQEKIRALQKQTLHMVTNPYISLARYKNNYIVATLPRTIGMHIGAIKDRDPQKKLSDYAINFNVFWSDDRQLIELSTVQYTGDMVRKIEAETGENNKWGENMKRTKTSLLLEILTKKTTDELTFKDWAFSTKKEIDSVTKKTYQGFPIGIIFEGNESSVKFGSQNYFPLPFDAKITPPTAEGFRLDWLRKGSFSSQMKTSYGLAIYSNKVTNAIPAYVIKNMFYKIARAENGKQIKAKFLKKYLDIAGNNYVPFIIMQHYRVLDTFEEMPISQPKVIRLSLTKTQHIIIKKDKTDSKM

SEQ ID NO: 65 - protein, 534 aa, Unknown
  source: /note="Description of Unknown: Cas14 sequence"
NTSNLINLGKKAINISANYDANLEVGCKNCKFLSSNGNFPRQTNVKEGCHSCEKSTYEPSIYLVKIGERKAKYDVLDSLKKFTFQSLKYQSKKSMKSRNKKPKELKEFVIFANKNKAFDVIQKSYNHLILQIKKEINRMNSKKRKKNHKRRLFRDREKQLNKLRLIESSNLFLPRENKGNNHVFTYVAIHSVGRDIGVIGSYDEKLNFETELTYQLYFNDDKRLLYAYKPKQNKIIKIKEKLWNLRKEKEPLDLEYEKPLNKSITFSIKNDNLFKVSKDLMLRRAKFNIQGKEKLSKEERKINRDLIKIKGLVNSMSYGRFDELKKEKNIWSPHIYREVRQKEIKPCLIKNGDRIEIFEQLKKKMERLRRFREKRQKKISKDLIFAERIAYNFHTKSIKNTSNKINIDQEAKRGKASYMRKRIGYETFKNKYCEQCLSKGNVYRNVQKGCSCFENPFDWIKKGDENLLPKKNEDLRVKGAFRDEALEKQIVKIAFNIAKGYEDFYDNLGESTEKDLKLKFKVGTTINEQESLKL

SEQ ID NO: 66 - protein, 537 aa, Unknown
  source: /note="Description of Unknown: Cas14 sequence"
TSNPIKLGKKAINISANYDSNLQIGCKNCKFLSYNGNFPRQTNVKEGCHSCEKSTYEPPVYTVRIGERRSKYDVLDSLKKFIFLSLKYRQSKKMKTRSKGIRGLEEFVISANLKKAMDVIQKSYRHLILNIKNEIVRMNGKKRNKNHKRLLFRDREKQLNKLRLIEGSSFFKPPTVKGDNSIFTCVAIHNIGRDIGIAGDYFDKLEPKIELTYQLYYEYNPKKESEINKRLLYAYKPKQNKIIEIKEKLWNLRKEKSPLDLEYEKPLTKSITFLVKRDGVFRISKDLMLRKAKFIIQGKEKLSKEERKINRDLIKIKSNIISLTYGRFDELKKDKTIWSPHIFRDVKQGKITPCIERKGDRMDIFQQLRKKSERLRENRKKRQKKISKDLIFAERIAYNFHTKSIKNTSNLINIKHEAKRGKASYMRKRIGNETFRIKYCEQCFPKNNVYKNVQKGCSCFEDPFEYIKKGNEDLIPNKNQDLKAKGAFRDDALEKQIIKVAFNIAKGYEDFYENLKKTTEKDIRLKFKVGTIISEEM

SEQ ID NO: 67 - protein, 541 aa, Unknown
  source: /note="Description of Unknown: Cas14 sequence"
NNSINLSKKAINISANYDANLQVRCKNCKFLSSNGNFPRQTDVKEGCHSCEKSTYEPPVYDVKIGEIKAKYEVLDSLKKFTFQSLKYQLSKSMKFRSKKIKELKEFVIFAKESKALNVINRSYKHLILNIKNDINRMNSKKRIKNHKGRLFLDRQKQLSKLKLIEGSSFFVPAKNVGNKSVFTCVAIHSIGRDIGIAGLYDSFTKPVNEITYQIFFSGERRLLYAYKPKQLKILSIKENLWSLKNEKKPLDLLYEKPLGKNLNFNVKGGDLFRVSKDLMIRNAKFNVHGRQRLSDEERLINRNFIKIKGEVVSLSYGRFEELKKDRKLWSPHIFKDVRQNKIKPCLVMQGQRIDIFEQLKRKLELLKKIRKSRQKKLSKDLIFGERIAYNFHTKSIKNTSNKINIDSDAKRGRASYMRKRIGNETFKLKYCDVCFPKANVYRRVQNGCSCSENPYNYIKKGDKDLLPKKDEGLAIKGAFRDEKLNKQIIKVAFNIAKGYEDFYDDLKKRTEKDVDLKFKIGTTVLDQKPMEIFDGIVITWL

SEQ ID NO: 68 - protein, 542 aa, Unknown
  source: /note="Description of Unknown: Cas14 sequence"
LLTTVVETNNLAKKAINVAANFDANIDRQYYRCTPNLCRFIAQSPRETKEKDAGCSSCTQSTYDPKVYVIKIGKLLAKYEILKSLKRFLFMNRYFKQKKTERAQQKQKIGTELNEMSIFAKATNAMEVIKRATKHCTYDIIPETKSLQMLKRRRHRVKVRSLLKILKERRMKIKKIPNTFIEIPKQAKKNKSDYYVAAALKSCGIDVGLCGAYEKNAEVEAEYTYQLYYEYKGNSSTKRILYCYNNPQKNIREFWEAFYIQGSKSHVNTPGTIRLKMEKFLSPITIESEALDFRVWNSDLKIRNGQYGFIKKRSLGKEAREIKKGMGDIKRKIGNLTYGKSPSELKSIHVYRTERENPKKPRAARKKEDNFMEIFEMQRKKDYEVNKKRRKEATDAAKIMDFAEEPIRHYHTNNLKAVRRIDMNEQVERKKTSVFLKRIMQNGYRGNYCRKCIKAPEGSNRDENVLEKNEGCLDCIGSEFIWKKSSKEKKGLWHTNRLLRRIRLQCFTTAKAYENFYNDLFEKKESSLDIIKLKVSITTKSM

SEQ ID NO: 69 - protein, 564 aa, Unknown
  source: /note="Description of Unknown: Cas14 sequence"
ASTMNLAKQAINFAANYDSNLEIGCKGCKFMSTWSKKSNPKFYPRQNNQANKCHSCTYSTGEPEVPIIEIGERAAKYKIFTALKKFVFMSVAYKERRRQRFKSKKPKELKELAICSNREKAMEVIQKSVVHCYGDVKQEIPRIRKIKVLKNHKGRLFYKQKRSKIKIAKLEKGSFFKTFIPKVHNNGCHSCHEASLNKPILVTTALNTIGADIGLINDYSTIAPTETDISWQVYYEFIPNGDSEAVKKRLLYFYKPKGALIKSIRDKYFKKGHENAVNTGFFKYQGKIVKGPIKFVNNELDFARKPDLKSMKIKRAGFAIPSAKRLSKEDREINRESIKIKNKIYSLSYGRKKTLSDKDIIKHLYRPVRQKGVKPLEYRKAPDGFLEFFYSLKRKERRLRKQKEKRQKDMSEIIDAADEFAWHRHTGSIKKTTNHINFKSEVKRGKVPIMKKRIANDSFNTRHCGKCVKQGNAINKYYIEKQKNCFDCNSIEFKWEKAALEKKGAFKLNKRLQYIVKACFNVAKAYESFYEDFRKGEEESLDLKFKIGTTTTLKQYPQNKARAM

SEQ ID NO: 70 - protein, 610 aa, Unknown
  source: /note="Description of Unknown: Cas14 sequence"
HSHNLMLTKLGKQAINFAANYDANLEIGCKNCKFLSYSPKQANPKKYPRQTDVHEDGNIACHSCMQSTKEPPVYIVPIGERKSKYEILTSLNKFTFLALKYKEKKRQAFRAKKPKELQELAIAFNKEKAIKVIDKSIQHLILNIKPEIARIQRQKRLKNRKGKLLYLHKRYAIKMGLIKNGKYFKVGSPKKDGKKLLVLCALNTIGRDIGIIGNIEENNRSETEITYQLYFDCLDANPNELRIKEIEYNRLKSYERKIKRLVYAYKPKQTKILEIRSKFFSKGHENKVNTGSFNFENPLNKSISIKVKNSAFDFKIGAPFIMLRNGKFHIPTKKRLSKEEREINRTLSKIKGRVFRLTYGRNISEQGSKSLHIYRKERQHPKLSLEIRKQPDSFIDEFEKLRLKQNFISKLKKQRQKKLADLLQFADRIAYNYHTSSLEKTSNFINYKPEVKRGRTSYIKKRIGNEGFEKLYCETCIKSNDKENAYAVEKEELCFVCKAKPFTWKKTNKDKLGIFKYPSRIKDFIRAAFTVAKSYNDFYENLKKKDLKNEIFLKFKIGLILSHEKKNHISIAKSVAEDERISGKSIKNILNKSIKLEKNCYSCFFHKEDM

SEQ ID NO: 71 - protein, 552 aa, Unknown
  source: /note="Description of Unknown: Cas14 sequence"
SLERVIDKRNLAKKAINIAANFDANINKGFYRCETNQCMFIAQKPRKTNNTGCSSCLQSTYDPVIYVVKVGEMLAKYEILKSLKRFVFMNRSFKQKKTEKAKQKERIGGELNEMSIFANAALAMGVIKRAIRHCHVDIRPEINRLSELKKTKHRVAAKSLVKIVKQRKTKWKGIPNSFIQIPQKARNKDADFYVASALKSGGIDIGLCGTYDKKPHADPRWTYQLYFDTEDESEKRLLYCYNDPQAKIRDFWKTFYERGNPSMVNSPGTIEFRMEGFFEKMTPISIESKDFDFRVWNKDLLIRRGLYEIKKRKNLNRKAREIKKAMGSVKRVLANMTYGKSPTDKKSIPVYRVEREKPKKPRAVRKEENELADKLENYRREDFLIRNRRKREATEIAKIIDAAEPPIRHYHTNHLRAVKRIDLSKPVARKNTSVFLKRIMQNGYRGNYCKKCIKGNIDPNKDECRLEDIKKCICCEGTQNIWAKKEKLYTGRINVLNKRIKQMKLECFNVAKAYENFYDNLAALKEGDLKVLKLKVSIPALNPEASDPEEDM

SEQ ID NO: 72 - protein, 577 aa, Unknown
  source: /note="Description of Unknown: Cas14 sequence"
SNLIKLGKQAINFAANYDANLEVGCKNCKFLSSTNKYPRQTNVHLDNKMACRSCNQSTMEPAIYIVRIGEKKAKYDIYNSLTKFNFQSLKYKAKRSQRFKPKQPKELQELSIAVRKEKALDIIQKSIDHLIQDIRPEIPRIKQQKRYKNHVGKLFYLQKRRKNKLNLIGKGSFFKVFSPKEKKNELLVICALTNIGRDIGLIGNYNTIINPLFEVTYQLYYDYIPKKNNKNVQRRLLYAYKSKNEKILKLKEAFFKRGHENAVNLGSFSYEKPLEKSLTLKIKNDKDDFQVSPSLRIRTGRFFVPSKRNLSRQEREINRRLVKIKSKIKNMTYGKFETARDKQSVHIFRLERQKEKLPLQFRKDEKEFMEEFQKLKRRTNSLKKLRKSRQKKLADLLQLSEKVVYNNHTGTLKKTSNFLNFSSSVKRGKTAYIKELLGQEGFETLYCSNCINKGQKTRYNIETKEKCFSCKDVPFVWKKKSTDKDRKGAFLFPAKLKDVIKATFTVAKAYEDFYDNLKSIDEKKPYIKFKIGLILAHVRHEHKARAKEEAGQKNIYNKPIKIDKNCKECFFFKEEAM

SEQ ID NO: 73 - protein, 613 aa, Unknown
  source: /note="Description of Unknown: Cas14 sequence"
NTTRKKFRKRTGFPQSDNIKLAYCSAIVRAANLDADIQKKHNQCNPNLCVGIKSNEQSRKYEHSDRQALLCYACNQSTGAPKVDYIQIGEIGAKYKILQMVNAYDFLSLAYNLTKLRNGKSRGHQRMSQLDEVVIVADYEKATEVIKRSINHLLDDIRGQLSKLKKRTQNEHITEHKQSKIRRKLRKLSRLLKRRRWKWGTIPNPYLKNWVFTKKDPELVTVALLHKLGRDIGLVNRSKRRSKQKLLPKVGFQLYYKWESPSLNNIKKSKAKKLPKRLLIPYKNVKLFDNKQKLENAIKSLLESYQKTIKVEFDQFFQNRTEEIIAEEQQTLERGLLKQLEKKKNEFASQKKALKEEKKKIKEPRKAKLLMEESRSLGFLMANVSYALFNTTIEDLYKKSNVVSGCIPQEPVVVFPADIQNKGSLAKILFAPKDGFRIKFSGQHLTIRTAKFKIRGKEIKILTKTKREILKNIEKLRRVWYREQHYKLKLFGKEVSAKPRFLDKRKTSIERRDPNKLADQTDDRQAELRNKEYELRHKQHKMAERLDNIDTNAQNLQTLSFWVGEADKPPKLDEKDARGFGVRTCISAWKWFMEDLLKKQEEDPLLKLKLSIM

SEQ ID NO: 74 - protein, 615 aa, Unknown
  source: /note="Description of Unknown: Cas14 sequence"
PKKPKFQKRTGFPQPDNLRKEYCLAIVRAANLDADFEKKCTKCEGIKTNKKGNIVKGRTYNSADKDNLLCYACNISTGAPAVDYVFVGALEAKYKILQMVKAYDFHSLAYNLAKLWKGRGRGHQRMGGLNEVVIVSNNEKALDVIEKSLNHFHDEIRGELSRLKAKFQNEHLHVHKESKLRRKLRKISRLLKRRRWKWDVIPNSYLRNFTFTKTRPDFISVALLHRVGRDIGLVTKTKIPKPTDLLPQFGFQIYYTWDEPKLNKLKKSRLRSEPKRLLVPYKKIELYKNKSVLEEAIRHLAEVYTEDLTICFKDFFETQKRKFVSKEKESLKRELLKELTKLKKDFSERKTALKRDRKEIKEPKKAKLLMEESRSLGFLAANTSYALFNLIAADLYTKSKKACSTKLPRQLSTILPLEIKEHKSTTSLAIKPEEGFKIRFSNTHLSIRTPKFKMKGADIKALTKRKREILKNATKLEKSWYGLKHYKLKLYGKEVAAKPRFLDKRNPSIDRRDPKELMEQIENRRNEVKDLEYEIRKGQHQMAKRLDNVDTNAQNLQTKSFWVGEADKPPELDSMEAKKLGLRTCISAWKWFMKDLVLLQEKSPNLKLKLSLTEM

SEQ ID NO: 75 - protein, 775 aa, Unknown
  source: /note="Description of Unknown: Cas14 sequence"
KFSKRQEGFLIPDNIDLYKCLAIVRSANLDADVQGHKSCYGVKKNGTYRVKQNGKKGVKEKGRKYVFDLIAFKGNIEKIPHEAIEEKDQGRVIVLGKFNYKLILNIEKNHNDRASLEIKNKIKKLVQISSLETGEFLSDLLSGKIGIDEVYGIIEPDVFSGKELVCKACQQSTYAPLVEYMPVGELDAKYKILSAIKGYDFLSLAYNLSRNRANKKRGHQKLGGGELSEVVISANYDKALNVIKRSINHYHVEIKPEISKLKKKMQNEPLKVMKQARIRRELHQLSRKVKRLKWKWGMIPNPELQNIIFEKKEKDFVSYALLHTLGRDIGLFKDTSMLQVPNISDYGFQIYYSWEDPKLNSIKKIKDLPKRLLIPYKRLDFYIDTILVAKVIKNLIELYRKSYVYETFGEEYGYAKKAEDILFDWDSINLSEGIEQKIQKIKDEFSDLLYEARESKRQNFVESFENILGLYDKNFASDRNSYQEKIQSMIIKKQQENIEQKLKREFKEVIERGFEGMDQNKKYYKVLSPNIKGGLLYTDTNNLGFFRSHLAFMLLSKISDDLYRKNNLVSKGGNKGILDQTPETMLTLEFGKSNLPNISIKRKFFNIKYNSSWIGIRKPKFSIKGAVIREITKKVRDEQRLIKSLEGVWHKSTHFKRWGKPRFNLPRHPDREKNNDDNLMESITSRREQIQLLLREKQKQQEKMAGRLDKIDKEIQNLQTANFQIKQIDKKPALTEKSEGKQSVRNALSAWKWFMEDLIKYQKRTPILQLKLAKM

SEQ ID NO: 76 - protein, 777 aa, Unknown
  source: /note="Description of Unknown: Cas14 sequence"
KFSKRQEGFVIPENIGLYKCLAIVRSANLDADVQGHVSCYGVKKNGTYVLKQNGKKSIREKGRKYASDLVAFKGDIEKIPFEVIEEKKKEQSIVLGKFNYKLVLDVMKGEKDRASLTMKNKSKKLVQVSSLGTDEFLLTLLNEKFGIEEIYGIIEPEVFSGKKLVCKACQQSTYAPLVEYMPVGELDSKYKILSAIKGYDFLSLAYNLARHRSNKKRGHQKLGGGELSEVVISANNAKALNVIKRSLNHYYSEIKPEISKLRKKMQNEPLKVGKQARMRRELHQLSRKVKRLKWKWGKIPNLELQNITFKESDRDFISYALLHTLGRDIGMFNKTEIKMPSNILGYGFQIYYDWEEPKLNTIKKSKNTPKRILIPYKKLDFYNDSILVARAIKELVGLFQESYEWEIFGNEYNYAKEAEVELIKLDEESINGNVEKKLQRIKENFSNLLEKAREKKRQNFIESFESIARLYDESFTADRNEYQREIQSFIIEKQKQSIEKKLKNEFKKIVEKKFNEQEQGKKHYRVLNPTIINEFLPKDKNNLGFLRSKIAFILLSKISDDLYKKSNAVSKGGEKGIIKQQPETILDLEFSKSKLPSINIKKKLFNIKYTSSWLGIRKPKFNIKGAKIREITRRVRDVQRTLKSAESSWYASTHFRRWGFPRFNQPRHPDKEKKSDDRLIESITLLREQIQILLREKQKGQKEMAGRLDDVDKKIQNLQTANFQIKQTGDKPALTEKSAGKQSFRNALSAWKWFMENLLKYQNKTPDLKLKIARTVM

SEQ ID NO: 77 - protein, 610 aa, Unknown
  source: /note="Description of Unknown: Cas14 sequence"
KWIEPNNIDFNKCLAITRSANLDADVQGHKMCYGIKTNGTYKAIGKINKKHNTGIIEKRRTYVYDLIVTKEKNEKIVKKTDFMAIDEEIEFDEKKEKLLKKYIKAEVLGTGELIRKDLNDGEKFDDLCSIEEPQAFRRSELVCKACNQSTYASDIRYIPIGEIEAKYKILKAIKGYDFLSLKYNLGRLRDSKKRGHQKMGQGELKEFVICANKEKALDVIKRSLNHYLNEVKDEISRLNKKMQNEPLKVNDQARWRRELNQISRRLKRLKWKWGEIPNPELKNLIFKSSRPEFVSYALIHTLGRDIGLINETELKPNNIQEYGFQIYYKWEDPELNHIKKVKNIPKRFIIPYKNLDLFGKYTILSRAIEGILKLYSSSFQYKSFKDPNLFAKEGEKKITNEDFELGYDEKIKKIKDDFKSYKKALLEKKKNTLEDSLNSILSVYEQSLLTEQINNVKKWKEGLLKSKESIHKQKKIENIEDIISRIEELKNVEGWIRTKERDIVNKEETNLKREIKKELKDSYYEEVRKDFSDLKKGEESEKKPFREEPKPIVIKDYIKFDVLPGENSALGFFLSHLSFNLFDSIQYELFEKSRLSSSKHPQIPETILDL

SEQ ID NO: 78 - protein, 632 aa, Unknown
  source: /note="Description of Unknown: Cas14 sequence"
FRKFVKRSGAPQPDNLNKYKCIAIVRAANLDADIMSNESSNCVMCKGIKMNKRKTAKGAAKTTELGRVYAGQSGNLLCTACTKSTMGPLVDYVPIGRIRAKYTILRAVKEYDFLSLAYNLARTRVSKKGGRQKMHSLSELVIAAEYEIAWNIIKSSVIHYHQETKEEISGLRKKLQAEHIHKNKEARIRREMHQISRRIKRLKWKWHMIPNSELHNFLFKQQDPSFVAVALLHTLGRDIGMINKPKGSAKREFIPEYGFQIYYKWMNPKLNDINKQKYRKMPKRSLIPYKNLNVFGDRELIENAMHKLLKLYDENLEVKGSKFFKTRVVAISSKESEKLKRDLLWKGELAKIKKDFNADKNKMQELFKEVKEPKKANALMKQSRNMGFLLQNISYGALGLLANRMYEASAKQSKGDATKQPSIVIPLEMEFGNAFPKLLLRSGKFAMNVSSPWLTIRKPKFVIKGNKIKNITKLMKDEKAKLKRLETSYHRATHFRPTLRGSIDWDSPYFSSPKQPNTHRRSPDRLSADITEYRGRLKSVEAELREGQRAMAKKLDSVDMTASNLQTSNFQLEKGEDPRLTEIDEKGRSIRNCISSWKKFMEDLMKAQEANPVIKIKIALKDESSVLSEDSM

SEQ ID NO: 79 - protein, 625 aa, Unknown
  source: /note="Description of Unknown: Cas14 sequence"
KFHPENLNKSYCLAIVRAANLDADIQGHINCIGIKSNKSDRNYENKLESLQNVELLCKACTKSTYKPNINSVPVGEKKAKYSILSEIKKYDFNSLVYNLKKYRKGKSRGHQKLNELRELVITSEYKKALDVINKSVNHYLVNIKNKMSKLKKILQNEHIHVGTLARIRRERNRISRKLDHYRKKWKFVPNKILKNYVFKNQSPDFVSVALLHKLGRDIGLITKTAILQKSFPEYSLQLYYKYDTPKLNYLKKSKFKSLPKRILISYKYPKFDINSNYIEESIDKLLKLYEESPIYKNNSKIIEFFKKSEDNLIKSENDSLKRGIMKEFEKVTKNFSSKKKKLKEELKLKNEDKNSKMLAKVSRPIGFLKAYLSYMLFNIISNRIFEFSRKSSGRIPQLPSCIINLGNQFENFKNELQDSNIGSKKNYKYFCNLLLKSSGFNISYEEEHLSIKTPNFFINGRKLKEITSEKKKIRKENEQLIKQWKKLTFFKPSNLNGKKTSDKIRFKSPNNPDIERKSEDNIVENIAKVKYKLEDLLSEQRKEFNKLAKKHDGVDVEAQCLQTKSFWIDSNSPIKKSLEKKNEKVSVKKKMKAIRSCISAWKWFMADLIEAQKETPMIKLKLALM

SEQ ID NO: 80 - protein, 517 aa, Unknown
  source: /note="Description of Unknown: Cas14 sequence"
TTLVPSHLAGIEVMDETTSRNEDMIQKETSRSNEDENYLGVKNKCGINVHKSGRGSSKHEPNMPPEKSGEGQMPKQDSTEMQQRFDESVTGETQVSAGATASIKTDARANSGPRVGTARALIVKASNLDRDIKLGCKPCEYIRSELPMGKKNGCNHCEKSSDIASVPKVESGFRKAKYELVRRFESFAADSISRHLGKEQARTRGKRGKKDKKEQMGKVNLDEIAILKNESLIEYTENQILDARSNRIKEWLRSLRLRLRTRNKGLKKSKSIRRQLITLRRDYRKWIKPNPYRPDEDPNENSLRLHTKLGVDIGVQGGDNKRMNSDDYETSFSITWRDTATRKICFTKPKGLLPRHMKFKLRGYPELILYNEELRIQDSQKFPLVDWERIPIFKLRGVSLGKKKVKALNRITEAPRLVVAKRIQVNIESKKKKVLTRYVYNDKSINGRLVKAEDSNKDPLLEFKKQAEEINSDAKYYENQEIAKNYLWGCEGLHKNLLEEQTKNPYLAFKYGFLNIV

SEQ ID NO: 81 - protein, 410 aa, Unknown
  source: /note="Description of Unknown: Cas14 sequence"
LDFKRTCSQELVLLPEIEGLKLSGTQGVTSLAKKLINKAANVDRDESYGCHHCIHTRTSLSKPVKKDCNSCNQSTNHPAVPITLKGYKIAFYELWHRFTSWAVDSISKALHRNKVMGKVNLDEYAVVDNSHIVCYAVRKCYEKRQRSVRLHKRAYRCRAKHYNKSQPKVGRIYKKSKRRNARNLKKEAKRYFQPNEITNGSSDALFYKIGVDLGIAKGTPETEVKVDVSICFQVYYGDARRVLRVRKMDELQSFHLDYTGKLKLKGIGNKDTFTIAKRNESLKWGSTKYEVSRAHKKFKPFGKKGSVKRKCNDYFRSIASWSCEAASQRAQSNLKNAFPYQKALVKCYKNLDYKGVKKNDMWYRLCSNRIFRYSRIAEDIAQYQSDKGKAKFEFVILAQSVAEYDISAIM

SEQ ID NO: 82 - protein, 602 aa, Unknown
  source: /note="Description of Unknown: Cas14 sequence"
VFLTDDKRKTALRKIRSAFRKTAEIALVRAQEADSLDRQAKKLTIETVSFGAPGAKNAFIGSLQGYNWNSHRANVPSSGSAKDVFRITELGLGIPQSAHEASIGKSFELVGNVVRYTANLLSKGYKKGAVNKGAKQQREIKGKEQLSFDLISNGPISGDKLINGQKDALAWWLIDKMGFHIGLAMEPLSSPNTYGITLQAFWKRHTAPRRYSRGVIRQWQLPFGRQLAPLIHNFFRKKGASIPIVLTNASKKLAGKGVLLEQTALVDPKKWWQVKEQVTGPLSNIWERSVPLVLYTATFTHKHGAAHKRPLTLKVIRISSGSVFLLPLSKVTPGKLVRAWMPDINILRDGRPDEAAYKGPDLIRARERSFPLAYTCVTQIADEWQKRALESNRDSITPLEAKLVTGSDLLQIHSTVQQAVEQGIGGRISSPIQELLAKDALQLVLQQLFMTVDLLRIQWQLKQEVADGNTSEKAVGWAIRISNIHKDAYKTAIEPCTSALKQAWNPLSGFEERTFQLDASIVRKRSTAKTPDDELVIVLRQQAAEMTVAVTQSVSKELMELAVRHSATLHLLVGEVASKQLSRSADKDRGAMDHWKLLSQSM

SEQ ID NO: 83 - protein, 494 aa, Unknown
  source: /note="Description of Unknown: Cas14 sequence"
EDLLQKALNTATNVAAIERHSCISCLFTESEIDVKYKTPDKIGQNTAGCQSCTFRVGYSGNSHTLPMGNRIALDKLRETIQRYAWHSLLFNVPPAPTSKRVRAISELRVAAGRERLFTVITFVQTNILSKLQKRYAANWTPKSQERLSRLREEGQHILSLLESGSWQQKEVVREDQDLIVCSALTKPGLSIGAFCRPKYLKPAKHALVLRLIFVEQWPGQIWGQSKRTRRMRRRKDVERVYDISVQAWALKGKETRISECIDTMRRHQQAYIGVLPFLILSGSTVRGKGDCPILKEITRMRYCPNNEGLIPLGIFYRGSANKLLRVVKGSSFTLPMWQNIETLPHPEPFSPEGWTATGALYEKNLAYWSALNEAVDWYTGQILSSGLQYPNQNEFLARLQNVIDSIPRKWFRPQGLKNLKPNGQEDIVPNEFVIPQNAIRAHHVIEWYHKTNDLVAKTLLGWGSQTTLNQTRPQGDLRFTYTRYYFREKEVPEV

SEQ ID NO: 84 - protein, 649 aa, Unknown
  source: /note="Description of Unknown: Cas14 sequence"
VPKKKLMRELAKKAVFEAIFNDPIPGSFGCKRCTLIDGARVTDAIEKKQGAKRCAGCEPCTFHTLYDSVKHALPAATGCDRTAIDTGLWEILTALRSYNWMSFRRNAVSDASQKQVWSIEELAIWADKERALRVILSALTHTIGKLKNGFSRDGVWKGGKQLYENLAQKDLAKGLFANGEIFGKELVEADHDMLAWTIVPNHQFHIGLIRGNWKPAAVEASTAFDARWLTNGAPLRDTRTHGHRGRRFNRTEKLTVLCIKRDGGVSEEFRQERDYELSVMLLQPKNKLKPEPKGELNSFEDLHDHWWFLKGDEATALVGLTSDPTVGDFIQLGLYIRNPIKAHGETKRRLLICFEPPIKLPLRRAFPSEAFKTWEPTINVFRNGRRDTEAYYDIDRARVFEFPETRVSLEHLSKQWEVLRLEPDRENTDPYEAQQNEGAELQVYSLLQEAAQKMAPKVVIDPFGQFPLELFSTFVAQLFNAPLSDTKAKIGKPLDSGFVVESHLHLLEEDFAYRDFVRVTFMGTEPTFRVIHYSNGEGYWKKTVLKGKNNIRTALIPEGAKAAVDAYKNKRCPLTLEAAILNEEKDRRLVLGNKALSLLAQTARGNLTILEALAAEVLRPLSGTEGVVHLHACVTRHSTLTESTETDNM

SEQ ID NO: 85 - protein, 414 aa, Unknown
  source: /note="Description of Unknown: Cas14 sequence"
VEKLFSERLKRAMWLKNEAGRAPPAETLTLKHKRVSGGHEKVKEELQRVLRSLSGTNQAAWNLGLSGGREPKSSDALKGEKSRVVLETVVFHSGHNRVLYDVIEREDQVHQRSSIMHMRRKGSNLLRLWGRSGKVRRKMREEVAEIKPVWHKDSRWLAIVEEGRQSVVGISSAGLAVFAVQESQCTTAEPKPLEYVVSIWFRGSKALNPQDRYLEFKKLKTTEALRGQQYDPIPFSLKRGAGCSLAIRGEGIKFGSRGPIKQFFGSDRSRPSHADYDGKRRLSLFSKYAGDLADLTEEQWNRTVSAFAEDEVRRATLANIQDFLSISHEKYAERLKKRIESIEEPVSASKLEAYLSAIFETFVQQREALASNFLMRLVESVALLISLEEKSPRVEFRVARYLAESKEGFNRKAM

SEQ ID NO: 86 - protein, 413 aa, Unknown
  source: /note="Description of Unknown: Cas14 sequence"
VVITQSELYKERLLRVMEIKNDRGRKEPRESQGLVLRFTQVTGGQEKVKQKLWLIFEGFSGTNQASWNFGQPAGGRKPNSGDALKGPKSRVTYETVVFHFGLRLLSAVIERHNLKQQRQTMAYMKRRAAARKKWARSGKKCSRMRNEVEKIKPKWHKDPRWFDIVKEGEPSIVGISSAGFAIYIVEEPNFPRQDPLEIEYAISIWFRRDRSQYLTFKKIQKAEKLKELQYNPIPFRLKQEKTSLVFESGDIKFGSRGSIEHFRDEARGKPPKADMDNNRRLTMFSVFSGNLTNLTEEQYARPVSGLLAPDEKRMPTLLKKLQDFFTPIHEKYGERIKQRLANSEASKRPFKKLEEYLPAIYLEFRARREGLASNWVLVLINSVRTLVRIKSEDPYIEFKVSQYLLEKEDNKAL

SEQ ID NO: 87 - protein, 449 aa, Unknown
  source: /note="Description of Unknown: Cas14 sequence"
KQDALFEERLKKAIFIKRQADPLQREELSLLPPNRKIVTGGHESAKDTLKQILRAINGTNQASWNPGTPSGKRDSKSADALAGPKSRVKLETVVFHVGHRLLKKVVEYQGHQKQQHGLKAFMRTCAAMRKKWKRSGKVVGELREQLANIQPKWHYDSRPLNLCFEGKPSVVGLRSAGIALYTIQKSVVPVKEPKPIEYAVSIWFRGPKAMDREDRCLEFKKLKIATELRKLQFEPIVSTLTQGIKGFSLYIQGNSVKFGSRGPIKYFSNESVRQRPPKADPDGNKRLALFSKFSGDLSDLTEEQWNRPILAFEGIIRRATLGNIQDYLTVGHEQFAISLEQLLSEKESVLQMSIEQQRLKKNLGKKAENEWVESFGAEQARKKAQGIREYISGFFQEYCSQREQWAENWVQQLNKSVRLFLTIQDSTPFIEFRVARYLPKGEKKKGKAM

SEQ ID NO: 88 - protein, 711 aa, Unknown
  source: /note="Description of Unknown: Cas14 sequence"
ANHAERHKRLRKEANRAANRNRPLVADCDTGDPLVGICRLLRRGDKMQPNKTGCRSCEQVEPELRDAILVSGPGRLDNYKYELFQRGRAMAVHRLLKRVPKLNRPKKAAGNDEKKAENKKSEIQKEKQKQRRMMPAVSMKQVSVADFKHVIENTVRHLFGDRRDREIAECAALRAASKYFLKSRRVRPRKLPKLANPDHGKELKGLRLREKRAKLKKEKEKQAELARSNQKGAVLHVATLKKDAPPMPYEKTQGRNDYTTFVISAAIKVGATRGTKPLLTPQPREWQCSLYWRDGQRWIRGGLLGLQAGIVLGPKLNRELLEAVLQRPIECRMSGCGNPLQVRGAAVDFFMTTNPFYVSGAAYAQKKFKPFGTKRASEDGAAAKAREKLMTQLAKVLDKVVTQAAHSPLDGIWETRPEAKLRAMIMALEHEWIFLRPGPCHNAAEEVIKCDCTGGHAILWALIDEARGALEHKEFYAVTRAHTHDCEKQKLGGRLAGFLDLLIAQDVPLDDAPAARKIKTLLEATPPAPCYKAATSIATCDCEGKFDKLWAIIDATRAGHGTEDLWARTLAYPQNVNCKCKAGKDLTHRLADFLGLLIKRDGPFRERPPHKVTGDRKLVFSGDKKCKGHQYVILAKAHNEEVVRAWISRWGLKSRTNKAGYAATELNLLLNWLSICRRRWMDMLTVQRDTPYIRMKTGRLVVDDKKERKAM

SEQ ID NO: 89 - protein, 574 aa, Unknown
  source: /note="Description of Unknown: Cas14 sequence"
AKQREALRVALERGIVRASNRTYTLVTNCTKGGPLPEQCRMIERGKARAMKWEPKLVGCGSCAAATVDLPAIEEYAQPGRLDVAKYKLTTQILAMATRRMMVRAAKLSRRKGQWPAKVQEEKEEPPEPKKMLKAVEMRPVAIVDFNRVIQTTIEHLWAERANADEAELKALKAAAAYFGPSLKIRARGPPKAAIGRELKKAHRKKAYAERKKARRKRAELARSQARGAAAHAAIRERDIPPMAYERTQGRNDVTTIPIAAAIKIAATRGARPLPAPKPMKWQCSLYWNEGQRWIRGGMLTAQAYAHAANIHRPMRCEMWGVGNPLKVRAFEGRVADPDGAKGRKAEFRLQTNAFYVSGAAYRNKKFKPFGTDRGGIGSARKKRERLMAQLAKILDKVVSQAAHSPLDDIWHTRPAQKLRAMIKQLEHEWMFLRPQAPTVEGTKPDVDVAGNMQRQIKALMAPDLPPIEKGSPAKRFTGDKRKKGERAVRVAEAHSDEVVTAWISRWGIQTRRNEGSYAAQELELLLNWLQICRRRWLDMTAAQRVSPYIRMKSGRMITDAADEGVAPIPLVENM

SEQ ID NO: 90 - protein, 743 aa, Unknown
  source: /note="Description of Unknown: Cas14 sequence"
KSISGRSIKHMACLKDMLKSEITEIEEKQKKESLRKWDYYSKFSDEILFRRNLNVSANHDANACYGCNPCAFLKEVYGFRIERRNNERIISYRRGLAGCKSCVQSTGYPPIEFVRRKFGADKAMEIVREVLHRRNWGALARNIGREKEADPILGELNELLLVDARPYFGNKSAANETNLAFNVITRAAKKFRDEGMYDIHKQLDIHSEEGKVPKGRKSRLIRIERKHKAIHGLDPGETWRYPHCGKGEKYGVWLNRSRLIHIKGNEYRCLTAFGTTGRRMSLDVACSVLGHPLVKKKRKKGKKTVDGTELWQIKKATETLPEDPIDCTFYLYAAKPTKDPFILKVGSLKAPRWKKLHKDFFEYSDTEKTQGQEKGKRVVRRGKVPRILSLRPDAKFKVSIWDDPYNGKNKEGTLLRMELSGLDGAKKPLILKRYGEPNTKPKNFVFWRPHITPHPLTFTPKHDFGDPNKKTKRRRVFNREYYGHLNDLAKMEPNAKFFEDREVSNKKNPKAKNIRIQAKESLPNIVAKNGRWAAFDPNDSLWKLYLHWRGRRKTIKGGISQEFQEFKERLDLYKKHEDESEWKEKEKLWENHEKEWKKTLEIHGSIAEVSQRCVMQSMMGPLDGLVQKKDYVHIGQSSLKAADDAWTFSANRYKKATGPKWGKISVSNLLYDANQANAELISQSISKYLSKQKDNQGCEGRKMKFLIKIIEPLRENFVKHTRWLHEMTQKDCEVRAQFSRVSM

SEQ ID NO: 91 - protein, 769 aa, Unknown
  source: /note="Description of Unknown: Cas14 sequence"
FPSDVGADALKHVRMLQPRLTDEVRKVALTRAPSDRPALARFAAVAQDGLAFVRHLNVSANHDSNCTFPRDPRDPRRGPCEPNPCAFLREVWGFRIVARGNERALSYRRGLAGCKSCVQSTGFPSVPFHRIGADDCMRKLHEILKARNWRLLARNIGREREADPLLTELSEYLLVDARTYPDGAAPNSGRLAENVIKRAAKKFRDEGMRDIHAQLRVHSREGKVPKGRLQRLRRIERKHRAIHALDPGPSWEAEGSARAEVQGVAVYRSQLLRVGHHTQQIEPVGIVARTLFGVGRTDLDVAVSVLGAPLTKRKKGSKTLESTEDFRIAKARETRAEDKIEVAFVLYPTASLLRDEIPKDAFPAMRIDRFLLKVGSVQADREILLQDDYYRFGDAEVKAGKNKGRTVTRPVKVPRLQALRPDAKFRVNVWADPFGAGDSPGTLLRLEVSGVTRRSQPLRLLRYGQPSTQPANFLCWRPHRVPDPMTFTPRQKFGERRKNRRTRRPRVFERLYQVHIKHLAHLEPNRKWFEEARVSAQKWAKARAIRRKGAEDIPVVAPPAKRRWAALQPNAELWDLYAHDREARKRFRGGRAAEGEEFKPRLNLYLAHEPEAEWESKRDRWERYEKKWTAVLEEHSRMCAVADRTLPQFLSDPLGARMDDKDYAFVGKSALAVAEAFVEEGTVERAQGNCSITAKKKFASNASRKRLSVANLLDVSDKADRALVFQAVRQYVQRQAENGGVEGRRMAFLRKLLAPLRQNFVCHTRWLHM

SEQ ID NO: 92 - protein, 564 aa, Unknown
  source: /note="Description of Unknown: Cas14 sequence"
AARKKKRGKIGITVKAKEKSPPAAGPFMARKLVNVAANVDGVEVHLCVECEADAHGSASARLLGGCRSCTGSIGAEGRLMGSVDVDRERVIAEPVHTETERLGPDVKAFEAGTAESKYAIQRGLEYWGVDLISRNRARTVRKMEEADRPESSTMEKTSWDEIAIKTYSQAYHASENHLFWERQRRVRQHALALFRRARERNRGESPLQSTQRPAPLVLAALHAEAAAISGRARAEYVLRGPSANVRAAAADIDAKPLGHYKTPSPKVARGFPVKRDLLRARHRIVGLSRAYFKPSDVVRGTSDAIAHVAGRNIGVAGGKPKEIEKTFTLPFVAYWEDVDRVVHCSSFKADGPWVRDQRIKIRGVSSAVGTFSLYGLDVAWSKPTSFYIRCSDIRKKFHPKGFGPMKHWRQWAKELDRLTEQRASCVVRALQDDEELLQTMERGQRYYDVFSCAATHATRGEADPSGGCSRCELVSCGVAHKVTKKAKGDTGIEAVAVAGCSLCESKLVGPSKPRVHRQMAALRQSHALNYLRRLQREWEALEAVQAPTPYLRFKYARHLEVRSM

SEQ ID NO: 93 - protein, 565 aa, Unknown
  source: /note="Description of Unknown: Cas14 sequence"
AAKKKKQRGKIGISVKPKEGSAPPADGPFMARKLVNVAANVDGVEVNLCIECEADAHGSAPARLLGGCKSCTGSIGAEGRLMGSVDVDRADAIAKPVNTETEKLGPDVQAFEAGTAETKYALQRGLEYWGVDLISRNRSRTVRRTEEGQPESATMEKTSWDEIAIKSYTRAYHASENHLFWERQRRVRQHALALFKRAKERNRGDSTLPREPGHGLVAIAALACEAYAVGGRNLAETVVRGPTFGTARAVRDVEIASLGRYKTPSPKVAHGSPVKRDFLRARHRIVGLARAYYRPSDVVRGTSDAIAHVAGRNIGVAGGKPRAVEAVFTLPFVAYWEDVDRVVHCSSFQVSAPWNRDQRMKIAGVTTAAGTFSLHGGELKWAKPTSFYIRCSDTRRKFRPKGFGPMKRWRQWAKDLDRLVEQRASCVVRALQDDAALLETMERGQRYYDVFACAVTHATRGEADRLAGCSRCALTPCQEAHRVTTKPRGDAGVEQVQTSDCSLCEGKLVGPSKPRLHRTLTLLRQEHGLNYLRRLQREWESLEAVQVPTPYLRFKYARHLEVRSM

SEQ ID NO: 94 - protein, 499 aa, Unknown
  source: /note="Description of Unknown: Cas14 sequence"
TDSQSESVPEVVYALTGGEVPGRVPPDGGSAEGARNAPTGLRKQRGKIKISAKPSKPGSPASSLARTLVNEAANVDGVQSSGCATCRMRANGSAPRALPIGCVACASSIGRAPQEETVCALPTTQGPDVRLLEGGHALRKYDIQRALEYWGVDLIGRNLDRQAGRGMEPAEGATATMKRVSMDELAVLDFGKSYYASEQHLFAARQRRVRQHAKALKIRAKHANRSGSVKRALDRSRKQVTALAREFFKPSDVVRGDSDALAHVVGRNLGVSRHPAREIPQTFTLPLCAYWEDVDRVISCSSLLAGEPFARDQEIRIEGVSSALGSLRLYRGAIEWHKPTSLYIRCSDTRRKFRPRGGLKKRWRQWAKDLDRLVEQRACCIVRSLQADVELLQTMERAQRFYDVHDCAATHVGPVAVRCSPCAGKQFDWDRYRLLAALRQEHALNYLRRLQREWESLEAQQVKMPYLRFKYARKLEVSGPLIGLEVRREPSMGTAIAEM

SEQ ID NO: 95 - protein, 358 aa, Unknown
  source: /note="Description of Unknown: Cas14 sequence"
AGTAGRRHGSLGARRSINIAGVTDRHGRWGCESCVYTRDQAGNRARCAPCDQSTYAPDVQEVTIGQRQAKYTIFLTLQSFSWTNTMRNNKRAAAGRSKRTTGKRIGQLAEIKITGVGLAHAHNVIQRSLQHNITKMWRAEKGKSKRVARLKKAKQLTKRRAYFRRRMSRQSRGNGFFRTGKGGIHAVAPVKIGLDVGMIASGSSEPADEQTVTLDAIWKGRKKKIRLIGAKGELAVAACRFREQQTKGDKCIPLILQDGEVRWNQNNWQCHPKKLVPLCGLEVSRKFVSQADRLAQNKVASPLAARFDKTSVKGTLVESDFAAVLVNVTSIYQQCHAMLLRSQEPTPSLRVQRTITSM

SEQ ID NO: 96 - protein, 369 aa, Unknown
  source: /note="Description of Unknown: Cas14 sequence"
GVRFSPAQSQVFFRTVIPQSVEARFAINMAAIHDAAGAFGCSVCRFEDRTPRNAKAVHGCSPCTRSTNRPDVFVLPVGAIKAKYDVFMRLLGFNWTHLNRRQAKRVTVRDRIGQLDELAISMLTGKAKAVLKKSICHNVDKSFKAMRGSLKKLHRKASKTGKSQLRAKLSDLRERTNTTQEGSHVEGDSDVALNKIGLDVGLVGKPDYPSEESVEVVVCLYFVGKVLILDAQGRIRDMRAKQYDGFKIPIIQRGQLTVLSVKDLGKWSLVRQDYVLAGDLRFEPKISKDRKYAECVKRIALITLQASLGFKERIPYYVTKQVEIKNASHIAFVTEAIQNCAENFREMTEYLMKYQEKSPDLKVLLTQLM

SEQ ID NO: 97 - protein, 486 aa, Unknown
  source: /note="Description of Unknown: Cas14 sequence"
RAVVGKVFLEQARRALNLATNFGTNHRTGCNGCYVTPGKLSIPQDGEKNAAGCTSCLMKATASYVSYPKPLGEKVAKYSTLDALKGFPWYSLRLNLRPNYRGKPINGVQEVAPVSKFRLAEEVIQAVQRYHFTELEQSFPGGRRRLRELRAFYTKEYRRAPEQRQHVVNGDRNIVVVTVLHELGFSVGMFNEVELLPKTPIECAVNVFIRGNRVLLEVRKPQFDKERLLVESLWKKDSRRHTAKWTPPNNEGRIFTAEGWKDFQLPLLLGSTSRSLRAIEKEGFVQLAPGRDPDYNNTIDEQHSGRPFLPLYLYLQGTISQEYCVFAGTWVIPFQDGISPYSTKDTFQPDLKRKAYSLLLDAVKHRLGNKVASGLQYGRFPAIEELKRLVRMHGATRKIPRGEKDLLKKGDPDTPEWWLLEQYPEFWRLCDAAAKRVSQNVGLLLSLKKQPLWQRRWLESRTRNEPLDNLPLSMALTLHLTNEEAL

SEQ ID NO: 98 - protein, 400 aa, Unknown
  source: /note="Description of Unknown: Cas14 sequence"
AAVYSKFYIENHFKMGIPETLSRIRGPSIIQGFSVNENYINIAGVGDRDFIFGCKKCKYTRGKPSSKKINKCHPCKRSTYPEPVIDVRGSISEFKYKIYNKLKQEPNQSIKQNTKGRMNPSDHTSSNDGIIINGIDNRIAYNVIFSSYKHLMEKQINLLRDTTKRKARQIKKYNNSGKKKHSLRSQTKGNLKNRYHMLGMFKKGSLTITNEGDFITAVRKVGLDISLYKNESLNKQEVETELCLNIKWGRTKSYTVSGYIPLPINIDWKLYLFEKETGLTLRLFGNKYKIQSKKFLIAQLFKPKRPPCADPVVKKAQKWSALNAHVQQMAGLFSDSHLLKRELKNRMHKQLDFKSLWVGTEDYIKWFEELSRSYVEGAEKSLEFFRQDYFCFNYTKQTTM

SEQ ID NO: 99 - protein, 666 aa, Unknown
  source: /note="Description of Unknown: Cas14 sequence"
PQQQRDLMLMAANYDQDYGNGCGPCTVVASAAYRPDPQAQHGCKRHLRTLGASAVTHVGLGDRTATITALHRLRGPAALAARARAAQAASAPMTPDTDAPDDRRRLEAIDADDVVLVGAHRALWSAVRRWADDRRAALRRRLHSEREWLLKDQIRWAELYTLIEASGTPPQGRWRNTLGALRGQSRWRRVLAPTMRATCAETHAELWDALAELVPEMAKDRRGLLRPPVEADALWRAPMIVEGWRGGHSVVVDAVAPPLDLPQPCAWTAVRLSGDPRQRWGLHLAVPPLGQVQPPDPLKATLAVSMRHRGGVRVRTLQAMAVDADAPMQRHLQVPLTLQRGGGLQWGIHSRGVRRREARSMASWEGPPIWTGLQLVNRWKGQGSALLAPDRPPDTPPYAPDAAVAPAQPDTKRARRTLKEACTVCRCAPGHMRQLQVTLTGDGTWRRFRLRAPQGAKRKAEVLKVATQHDERIANYTAWYLKRPEHAAGCDTCDGDSRLDGACRGCRPLLVGDQCFRRYLDKIEADRDDGLAQIKPKAQEAVAAMAAKRDARAQKVAARAAKLSEATGQRTAATRDASHEARAQKELEAVATEGTTVRHDAAAVSAFGSWVARKGDEYRHQVGVLANRLEHGLRLQELMAPDSVVADQQRASGHARVGYRYVLTAM

SEQ ID NO: 100 - protein, 560 aa, Unknown
  source: /note="Description of Unknown: Cas14 sequence"
AVAHPVGRGNAGSPGARGPEELPRQLVNRASNVTRPATYGCAPCRHVRLSIPKPVLTGCRACEQTTHPAPKRAVRGGADAAKYDLAAFFAGWAADLEGRNRRRQVHAPLDPQPDPNHEPAVTLQKIDLAEVSIEEFQRVLARSVKHRHDGRASREREKARAYAQVAKKRRNSHAHGARTRRAVRRQTRAVRRAHRMGANSGEILVASGAEDPVPEAIDHAAQLRRRIRACARDLEGLRHLSRRYLKTLEKPCRRPRAPDLGRARCHALVESLQAAERELEELRRCDSPDTAMRRLDAVLAAAASTDATFATGWTVVGMDLGVAPRGSAAPEVSPMEMAISVFWRKGSRRVIVSKPIAGMPIRRHELIRLEGLGTLRLDGNHYTGAGVTKGRGLSEGTEPDFREKSPSTLGFTLSDYRHESRWRPYGAKQGKTARQFFAAMSRELRALVEHQVLAPMGPPLLEAHERRFETLLKGQDNKSIHAGGGGRYVWRGPPDSKKRPAADGDWFRFGRGHADHRGWANKRHELAANYLQSAFRLWSTLAEAQEPTPYARYKYTRVTM

SEQ ID NO: 101 - protein, 404 aa, Unknown
  source: /note="Description of Unknown: Cas14 sequence"
WDFLTLQVYERHTSPEVCVAGNSTKCASGTRKSDHTHGVGVKLGAQEINVSANDDRDHEVGCNICVISRVSLDIKGWRYGCESCVQSTPEWRSIVRFDRNHKEAKGECLSRFEYWGAQSIARSLKRNKLMGGVNLDELAIVQNENVVKTSLKHLFDKRKDRIQANLKAVKVRMRERRKSGRQRKALRRQCRKLKRYLRSYDPSDIKEGNSCSAFTKLGLDIGISPNKPPKIEPKVEVVFSLFYQGACDKIVTVSSPESPLPRSWKIKIDGIRALYVKSTKVKFGGRTFRAGQRNNRRKVRPPNVKKGKRKGSRSQFFNKFAVGLDAVSQQLPIASVQGLWGRAETKKAQTICLKQLESNKPLKESQRCLFLADNWVVRVCGFLRALSQRQGPTPYIRYRYRCNM

SEQ ID NO: 102 - protein, 392 aa, Unknown
  source: /note="Description of Unknown: Cas14 sequence"
ARNVGQRNASRQSKRESAKARSRRVTGGHASVTQGVALINAAANADRDHTTGCEPCTWERVNLPLQEVIHGCDSCTKSSPFWRDIKVVNKGYREAKEEIMRIASGISADHLSRALSHNKVMGRLNLDEVCILDFRTVLDTSLKHLTDSRSNGIKEHIRAVHRKIRMRRKSGKTARALRKQYFALRRQWKAGHKPNSIREGNSLTALRAVGFDVGVSEGTEPMPAPQTEVVLSVFYKGSATRILRISSPHPIAKRSWKVKIAGIKALKLIRREHDFSFGRETYNASQRAEKRKFSPHAARKDFFNSFAVQLDRLAQQLCVSSVENLWVTEPQQKLLTLAKDTAPYGIREGARFADTRARLAWNWVFRVCGFTRALHQEQEPTPYCRFTWRSKM

SEQ ID NO: 103 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 104 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 105 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 106 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 107 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 108 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 109 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 110 - protein, 1182 aa, Leptotrichia wadei
MYMKITKIDGVSHYKKQDKGILKKKWKDLDERKQREKIEARYNKQIESKIYKEFFRLKNKKRIEKEEDQNIKSLYFFIKELYLNEKNEEWELKNINLEILDDKERVIKGYKFKEDVYFFKEGYKEYYLRILFNNLIEKVQNENREKVRKNKEFLDLKEIFKKYKNRKIDLLLKSINNNKINLEYKKENVNEEIYGINPTNDREMTFYELLKEIIEKKDEQKSILEEKLDNFDITNFLENIEKIFNEETEINIIKGKVLNELREYIKEKEENNSDNKLKQIYNLELKKYIENNFSYKKQKSKSKNGKNDYLYLNFLKKIMFIEEVDEKKEINKEKFKNKINSNFKNLFVQHILDYGKLLYYKENDEYIKNTGQLETKDLEYIKTKETLIRKMAVLVSFAANSYYNLFGRVSGDILGTEVVKSSKTNVIKVGSHIFKEKMLNYFFDFEIFDANKIVEILESISYSIYNVRNGVGHFNKLILGKYKKKDINTNKRIEEDLNNNEEIKGYFIKKRGEIERKVKEKFLSNNLQYYYSKEKIENYFEVYEFEILKRKIPFAPNFKRIIKKGEDLFNNKNNKKYEYFKNFDKNSAEEKKEFLKTRNFLLKELYYNNFYKEFLSKKEEFEKIVLEVKEEKKSRGNINNKKSGVSFQSIDDYDTKINISDYIASIHKKEMERVEKYNEEKQKDTAKYIRDFVEEIFLTGFINYLEKDKRLHFLKEEFSILCNNNNNVVDFNININEEKIKEFLKENDSKTLNLYLFFNMIDSKRISEFRNELVKYKQFTKKRLDEEKEFLGIKIELYETLIEFVILTREKLDTKKSEEIDAWLVDKLYVKDSNEYKEYEEILKLFVDEKILSSKEAPYYATDNKTPILLSNFEKTRKYGTQSFLSEIQSNYKYSKVEKENIEDYNKKEEIEQKKKSNIEKLQDLKVELHKKWEQNKITEKEIEKYNNTTRKINEYNYLKNKEELQNVYLLHEMLSDLLARNVAFFNKWERDFKFIVIAIKQFLRENDKEKVNEFLNPPDNSKGKKVYFSVSKYKNTVENIDGIHKNFMNLIFLNNKFMNRKIDKMNCAIWVYFRNYIAHFLHLHTKNEKISLISQMNLLIKLFSYDKKVQNHILKSTKTLLEKYNIQINFEISNDKNEVFKYKIKNRLYSKKGKMLGKNNKFEILENEFLENVKAMLEYSE

SEQ ID NO: 111 - RNA, 5 nt, Artificial Sequence
  source: /note="Description of Artificial Sequence: Synthetic oligonucleotide"
uuuuu

SEQ ID NO: 112 - RNA, 8 nt, Artificial Sequence
  source: /note="Description of Artificial Sequence: Synthetic oligonucleotide"
uuuuuuuu

SEQ ID NO: 113 - RNA, 10 nt, Artificial Sequence
  source: /note="Description of Artificial Sequence: Synthetic oligonucleotide"
uuuuuuuuuu

SEQ ID NO: 114 - DNA, 10 bp, Artificial Sequence
  source: /note="Description of Artificial Sequence: Synthetic oligonucleotide"
  source: /note="Description of Combined DNA/RNA Molecule: Synthetic oligonucleotide"
ttttuutttt

SEQ ID NO: 115 - DNA, 6 bp, Artificial Sequence
  source: /note="Description of Artificial Sequence: Synthetic oligonucleotide"
  source: /note="Description of Combined DNA/RNA Molecule: Synthetic oligonucleotide"
ttuutt

SEQ ID NO: 116 - DNA, 6 bp, Artificial Sequence
  source: /note="Description of Artificial Sequence: Synthetic oligonucleotide"
  source: /note="Description of Combined DNA/RNA Molecule: Synthetic oligonucleotide"
taaugc

SEQ ID NO: 117 - DNA, 6 bp, Artificial Sequence
  source: /note="Description of Artificial Sequence: Synthetic oligonucleotide"
  source: /note="Description of Combined DNA/RNA Molecule: Synthetic oligonucleotide"
tauggc

SEQ ID NO: 118 - RNA, 5 nt, Artificial Sequence
  source: /note="Description of Artificial Sequence: Synthetic oligonucleotide"
uuuuu

SEQ ID NO: 119 - DNA, 8 bp, Artificial Sequence
  source: /note="Description of Artificial Sequence: Synthetic oligonucleotide"
ttattatt

SEQ ID NO: 120 - DNA, 6 bp, Artificial Sequence
  source: /note="Description of Artificial Sequence: Synthetic oligonucleotide"
tttttt

SEQ ID NO: 121 - DNA, 8 bp, Artificial Sequence
  source: /note="Description of Artificial Sequence: Synthetic oligonucleotide"
tttttttt

SEQ ID NO: 122 - DNA, 10 bp, Artificial Sequence
  source: /note="Description of Artificial Sequence: Synthetic oligonucleotide"
tttttttttt

SEQ ID NO: 123 - DNA, 12 bp, Artificial Sequence
  source: /note="Description of Artificial Sequence: Synthetic oligonucleotide"
tttttttttttt

SEQ ID NO: 124 - DNA, 14 bp, Artificial Sequence
  source: /note="Description of Artificial Sequence: Synthetic oligonucleotide"
tttttttttttttt

SEQ ID NO: 125 - DNA, 6 bp, Artificial Sequence
  source: /note="Description of Artificial Sequence: Synthetic oligonucleotide"
aaaaaa

SEQ ID NO: 126 - DNA, 6 bp, Artificial Sequence
  source: /note="Description of Artificial Sequence: Synthetic oligonucleotide"
cccccc

SEQ ID NO: 127 - DNA, 6 bp, Artificial Sequence
  source: /note="Description of Artificial Sequence: Synthetic oligonucleotide"
gggggg

SEQ ID NO: 128 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 129 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 130 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 131 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 132 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 133 - protein, 668 aa, Unknown
  source: /note="Description of Unknown: Cas13c sequence"
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 134 - protein, 796 aa, Unknown
  source: /note="Description of Unknown: Cas13c sequence"
MEKDKKGEKIDISQEMIEEDLRKILILFSRLRHSMVHYDYEFYQALYSGKDFVISDKNNLENRMISQLLDLNIFKELSKVKLIKDKAISNYLDKNTTIHVLGQDIKAIRLLDIYRDICGSKNGFNKFINTMITISGEEDREYKEKVIEHFNKKMENLSTYLEKLEKQDNAKRNNKRVYNLLKQKLIEQQKLKEWFGGPYVYDIHSSKRYKELYIERKKLVDRHSKLFEEGLDEKNKKELTKINDELSKLNSEMKEMTKLNSKYRLQYKLQLAFGFILEEFDLNIDTFINNFDKDKDLIISNFMKKRDIYLNRVLDRGDNRLKNIIKEYKFRDTEDIFCNDRDNNLVKLYILMYILLPVEIRGDFLGFVKKNYYDMKHVDFIDKKDKEDKDTFFHDLRLFEKNIRKLEITDYSLSSGFLSKEHKVDIEKKINDFINRNGAMKLPEDITIEEFNKSLILPIMKNYQINFKLLNDIEISALFKIAKDRSITFKQAIDEIKNEDIKKNSKKNDKNNHKDKNINFTQLMKRALHEKIPYKAGMYQIRNNISHIDMEQLYIDPLNSYMNSNKNNITISEQIEKIIDVCVTGGVTGKELNNNIINDYYMKKEKLVFNLKLRKQNDIVSIESQEKNKREEFVFKKYGLDYKDGEINIIEVIQKVNSLQEELRNIKETSKEKLKNKETLFRDISLINGTIRKNINFKIKEMVLDIVRMDEIRHINIHIYYKGENYTRSNIIKFKYAIDGENKKYYLKQHEINDINLELKDKFVTLICNMDKHPNKNKQTINLESNYIQNVKFIIP

SEQ ID NO: 135 - protein, 897 aa, Unknown
  source: /note="Description of Unknown: Cas13c sequence"
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 136 - protein, 919 aa, Unknown
  source: /note="Description of Unknown: Cas13c sequence"
MEEIKHKKNKSSIIRVIVSNYDMTGIKEIKVLYQKQGGVDTFNLKTIINLESGNLEIISCKPKEREKYRYEFNCKTEINTISITKKDKVLKKEIRKYSLELYFKNEKKDTVVAKVTDLLKAPDKIEGERNHLRKLSSSTERKLLSKTLCKNYSEISKTPIEEIDSIKIYKIKRFLNYRSNFLIYFALINDFLCAGVKEDDINEVWLIQDKEHTAFLENRIEKITDYIFDKLSKDIENKKNQFEKRIKKYKTSLEELKTETLEKNKTFYIDSIKTKITNLENKITELSLYNSKESLKEDLIKIISIFTNLRHSLMHYDYKSFENLFENIENEELKNLLDLNLFKSIRMSDEFKTKNRTNYLDGTESFTIVKKHQNLKKLYTYYNNLCDKKNGFNTFINSFFVTDGIENTDFKNLIILHFEKEMEEYKKSIEYYKIKISNEKNKSKKEKLKEKIDLLQSELINMREHKNLLKQIYFFDIHNSIKYKELYSERKNLIEQYNLQINGVKDVTAINHINTKLLSLKNKMDKITKQNSLYRLKYKLKIAYSFLMIEFDGDVSKFKNNFDPTNLEKRVEYLDKKEEYLNYTAPKNKFNFAKLEEELQKIQSTSEMGADYLNVSPENNLFKFYILTYIMLPVEFKGDFLGFVKNHYYNIKNVDFMDESLLDENEVDSNKLNEKIENLKDSSFFNKIRLFEKNIKKYEIVKYSVSTQENMKEYFKQLNLDIPYLDYKSTDEIGIFNKNMILPIFKYYQNVFKLCNDIEIHALLALANKKQQNLEYAIYCCSKKNSLNYNELLKTFNRKTYQNLSFIRNKIAHLNYKELFSDLFNNELDLNTKVRCLIEFSQNNKFDQIDLGMNFINDYYMKKTRFIFNQRRLRDLNVPSKEKIIDGKRKQQNDSNNELLKKYGLSRTNIKDIFNKAWY

SEQ ID NO: 137 - protein, 1110 aa, Unknown
  source: /note="Description of Unknown: Cas13c sequence"
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 138 - DNA, 18 bp, Artificial Sequence
  source: /note="Description of Artificial Sequence: Synthetic primer"
tggaacaagttgtggagg

SEQ ID NO: 139 - DNA, 22 bp, Artificial Sequence
  source: /note="Description of Artificial Sequence: Synthetic primer"
tgcagcatcatatagatcttga

SEQ ID NO: 140 - DNA, 49 bp, Artificial Sequence
  source: /note="Description of Artificial Sequence: Synthetic primer"
tagtgatgcttttgggttgttcaattgtatgagtatgctcaaaaattgg

SEQ ID NO: 141 - DNA, 40 bp, Artificial Sequence
  source: /note="Description of Artificial Sequence: Synthetic primer"
gtgtagtattgggcaatgctgctccttggtgtacctctgt

SEQ ID NO: 142 - DNA, 22 bp, Artificial Sequence
  source: /note="Description of Artificial Sequence: Synthetic primer"
tatggtagaatcctgcttctcc

SEQ ID NO: 143 - DNA, 21 bp, Artificial Sequence
  source: /note="Description of Artificial Sequence: Synthetic primer"
tggcctaggcataatgggaga

SEQ ID NO: 144 - DNA, 19 bp, Artificial Sequence
  source: /note="Description of Artificial Sequence: Synthetic primer"
aacaagttgtggaggtgta

SEQ ID NO: 145 - DNA, 22 bp, Artificial Sequence
  source: /note="Description of Artificial Sequence: Synthetic primer"
ccattttctttgagttgttcag

SEQ ID NO: 146 - DNA, 46 bp, Artificial Sequence
  source: /note="Description of Artificial Sequence: Synthetic primer"
tagtgatgcttttgggttgttcaagagtatgctcaaaaattgggtg

SEQ ID NO: 147 - DNA, 44 bp, Artificial Sequence
  source: /note="Description of Artificial Sequence: Synthetic primer"
gtattgggcaatgctgctggcatatagatcttgattccttggtg

SEQ ID NO: 148 - DNA, 22 bp, Artificial Sequence
  source: /note="Description of Artificial Sequence: Synthetic primer"
atatggtagaatcctgcttctc

SEQ ID NO: 149 - DNA, 22 bp, Artificial Sequence
  source: /note="Description of Artificial Sequence: Synthetic primer"
cctaggcataatgggagaatac

SEQ ID NO: 150 - DNA, 45 bp, Artificial Sequence
  source: /note="Description of Artificial Sequence: Synthetic primer"
atagtgatgcttttgggttgttcaagtatgctcaaaaattgggtg

SEQ ID NO: 151 - DNA, 44 bp, Artificial Sequence
  source: /note="Description of Artificial Sequence: Synthetic primer"
gctgctggcctaggcataatgcatcatatagatcttgattcctt

SEQ ID NO: 152 - DNA, 20 bp, Artificial Sequence
  source: /note="Description of Artificial Sequence: Synthetic primer"
gggagaatacagaggtacac

SEQ ID NO: 153 - DNA, 20 bp, Artificial Sequence
  source: /note="Description of Artificial Sequence: Synthetic primer"
gggtcttagcaaaatcagtt

SEQ ID NO: 154 - DNA, 42 bp, Artificial Sequence
  source: /note="Description of Artificial Sequence: Synthetic primer"
gaatcctgcttctccacccaattgacacgctagtgtacaagc

SEQ ID NO: 155 - DNA, 23 bp, Artificial Sequence
  source: /note="Description of Artificial Sequence: Synthetic primer"
cctccacaacttgttccatttct

SEQ ID NO: 156 - DNA, 20 bp, Artificial Sequence
  source: /note="Description of Artificial Sequence: Synthetic primer"
tggcctaggcataatgggag

SEQ ID NO: 157 - DNA, 20 bp, Artificial Sequence
  source: /note="Description of Artificial Sequence: Synthetic primer"
aagcagaaatggaacaagtt

SEQ ID NO: 158 - DNA, 43 bp, Artificial Sequence
  source: /note="Description of Artificial Sequence: Synthetic primer"
tagtgatgcttttgggttgttcagtggaggtgtatgagtatgc

SEQ ID NO: 159 - DNA, 45 bp, Artificial Sequence
  source: /note="Description of Artificial Sequence: Synthetic primer"
gtagtattgggcaatgctgctgatatagatcttgattccttggtg

SEQ ID NO: 160 - DNA, 22 bp, Artificial Sequence
  source: /note="Description of Artificial Sequence: Synthetic primer"
tgcttctccacccaatttttga

SEQ ID NO: 161 - DNA, 23 bp, Artificial Sequence
  source: /note="Description of Artificial Sequence: Synthetic primer"
gcctaggcataatgggagaatac

SEQ ID NO: 162 - DNA, 39 bp, Artificial Sequence
  source: /note="Description of Artificial Sequence: Synthetic primer"
gaatcctgcttctccacccagacacgctagtgtacaagc

SEQ ID NO: 163 - DNA, 18 bp, Artificial Sequence
  source: /note="Description of Artificial Sequence: Synthetic primer"
tacacagctgctgttcaa

SEQ ID NO: 164 - DNA, 19 bp, Artificial Sequence
  source: /note="Description of Artificial Sequence: Synthetic primer"
ggtaaatttgctgggcatt

SEQ ID NO: 165 - DNA, 42 bp, Artificial Sequence
  source: /note="Description of Artificial Sequence: Synthetic primer"
ttggaacatgggcacccataaatgtcctagaaaaagacgatg

SEQ ID NO: 166 - DNA, 44 bp, Artificial Sequence
  source: /note="Description of Artificial Sequence: Synthetic primer"
ctagtgaaacaaatatccacacccagcactgcacttcttgagtt

SEQ ID NO: 167 - DNA, 18 bp, Artificial Sequence
  source: /note="Description of Artificial Sequence: Synthetic primer"
ttgtaagtgatgcaggat

SEQ ID NO: 168 - DNA, 23 bp, Artificial Sequence
  source: /note="Description of Artificial Sequence: Synthetic primer"
agggaccctcattaagagtcatg

SEQ ID NO: 169 - DNA, 18 bp, Artificial Sequence
  source: /note="Description of Artificial Sequence: Synthetic primer"
atacacagctgctgttca

SEQ ID NO: 170 - DNA, 42 bp, Artificial Sequence
  source: /note="Description of Artificial Sequence: Synthetic primer"
tctgctggcatggatgattgaatgtcctagaaaaagacgatg

SEQ ID NO: 171 - DNA, 24 bp, Artificial Sequence
  source: /note="Description of Artificial Sequence: Synthetic primer"
cccatattgtaagtgatgcaggat

SEQ ID NO: 172 - DNA, 22 bp, Artificial Sequence
  source: /note="Description of Artificial Sequence: Synthetic primer"
agggaccctcattaagagtcat

SEQ ID NO: 173 - DNA, 19 bp, Artificial Sequence
  source: /note="Description of Artificial Sequence: Synthetic primer"
tggtaaatttgctgggcat

SEQ ID NO: 174 - DNA, 43 bp, Artificial Sequence
  source: /note="Description of Artificial Sequence: Synthetic primer"
tgaaacaaatatccacacccaagggcactgcacttcttgagtt

SEQ ID NO: 175 - DNA, 23 bp, Artificial Sequence
  source: /note="Description of Artificial Sequence: Synthetic primer"
ccatattgtaagtgatgcaggat

SEQ ID NO: 176 - DNA, 22 bp, Artificial Sequence
  source: /note="Description of Artificial Sequence: Synthetic primer"
gaccctcattaagagtcatgat

SEQ ID NO: 177 - DNA, 21 bp, Artificial Sequence
  source: /note="Description of Artificial Sequence: Synthetic primer"
aacatacgtgaacaaacttca

SEQ ID NO: 178 - DNA, 22 bp, Artificial Sequence
  source: /note="Description of Artificial Sequence: Synthetic primer"
gcacatatggtaaatttgctgg

SEQ ID NO: 179 - DNA, 43 bp, Artificial Sequence
  source: /note="Description of Artificial Sequence: Synthetic primer"
acccatattgtaagtgatgcaggatagggctccacatacacag

SEQ ID NO: 180 - DNA, 43 bp, Artificial Sequence
  source: /note="Description of Artificial Sequence: Synthetic primer"
ctagtgaaacaaatatccacacccaagcactgcacttcttgag

SEQ ID NO: 181 - DNA, 25 bp, Artificial Sequence
  source: /note="Description of Artificial Sequence: Synthetic primer"
tttctaggacattgtattgaacagc

SEQ ID NO: 182 - DNA, 22 bp, Artificial Sequence
  source: /note="Description of Artificial Sequence: Synthetic primer"
gggaccctcattaagagtcatg

SEQ ID NO: 183 - DNA, 19 bp, Artificial Sequence
  source: /note="Description of Artificial Sequence: Synthetic primer"
gacttgaagatgtctttgc

SEQ ID NO: 184 - DNA, 19 bp, Artificial Sequence
  source: /note="Description of Artificial Sequence: Synthetic primer"
tgttgtttgggtccccatt

SEQ ID NO: 185 - DNA, 39 bp, Artificial Sequence
  source: /note="Description of Artificial Sequence: Synthetic primer"
ttagtcagaggtgacaggattgcagatcttgaggctctc

SEQ ID NO: 186 - DNA, 39 bp, Artificial Sequence
  source: /note="Description of Artificial Sequence: Synthetic primer"
ttgtgttcacgctcaccgtgtttggacaaagcgtctacg

SEQ ID NO: 187 - DNA, 16 bp, Artificial Sequence
  source: /note="Description of Artificial Sequence: Synthetic primer"
gtcttgtctttagcca

SEQ ID NO: 188 - DNA, 16 bp, Artificial Sequence
  source: /note="Description of Artificial Sequence: Synthetic primer"
cagtgagcgaggactg

SEQ ID NO: 189 - DNA, 16 bp, Artificial Sequence
  source: /note="Description of Artificial Sequence: Synthetic primer"
accgaggtcgaaacgt

SEQ ID NO: 190 - DNA, 17 bp, Artificial Sequence
  source: /note="Description of Artificial Sequence: Synthetic primer"
ggtccccattcccattg

SEQ ID NO: 191 - DNA, 48 bp, Artificial Sequence
  source: /note="Description of Artificial Sequence: Synthetic primer"
caaagacatcttcaagtctctgcgttttttctctctatcgtcccgtca

SEQ ID NO: 192 - DNA, 46 bp, Artificial Sequence
  source: /note="Description of Artificial Sequence: Synthetic primer"
aatggctaaagacaagaccaatccttttttgtctacgctgcagtcc

SEQ ID NO: 193 - DNA, 18 bp, Artificial Sequence
  source: /note="Description of Artificial Sequence: Synthetic primer"
cgatctcggctttgaggg

SEQ ID NO: 194 - DNA, 17 bp, Artificial Sequence
  source: /note="Description of Artificial Sequence: Synthetic primer"
tcaccgtgcccagtgag

SEQ ID NO: 195 - DNA, 23 bp, Artificial Sequence
  source: /note="Description of Artificial Sequence: Synthetic primer"
cgaaagcaggtagatattgaaag

SEQ ID NO: 196 - DNA, 17 bp, Artificial Sequence
  source: /note="Description of Artificial Sequence: Synthetic primer"
tctacgctgcagtcctc

SEQ ID NO: 197 - DNA, 44 bp, Artificial Sequence
  source: /note="Description of Artificial Sequence: Synthetic primer"
tcaagtctctgcgcgatctcttttttgagtcttctaaccgaggt

SEQ ID NO: 198 - DNA, 53 bp, Artificial Sequence
  source: /note="Description of Artificial Sequence: Synthetic primer"
agatgtctttgcagggaaaaacacttttttcacaaatcctaaaatccccttag

SEQ ID NO: 199 - DNA, 24 bp, Artificial Sequence
  source: /note="Description of Artificial Sequence: Synthetic primer"
gacgatagagagaacgtacgtttc

SEQ ID NO: 200 - DNA, 21 bp, Artificial Sequence
  source: /note="Description of Artificial Sequence: Synthetic primer"
aagaccaatcctgtcacctct

SEQ ID NO: 201 - DNA, 21 bp, Artificial Sequence
  source: /note="Description of Artificial Sequence: Synthetic primer"
gcgaaagcaggtagatattga

SEQ ID NO: 202 - DNA, 19 bp, Artificial Sequence
  source: /note="Description of Artificial Sequence: Synthetic primer"
cattcccattgagggcatt

SEQ ID NO: 203 - DNA, 41 bp, Artificial Sequence
  source: /note="Description of Artificial Sequence: Synthetic primer"
cttcaagtctctgcgcgatctatgagtcttctaaccgaggt

SEQ ID NO: 204 - DNA, 41 bp, Artificial Sequence
  source: /note="Description of Artificial Sequence: Synthetic primer"
ttgaggctctcatggaatggcagcgtgaacacaaatcctaa

SEQ ID NO: 205 - DNA, 20 bp, Artificial Sequence
  source: /note="Description of Artificial Sequence: Synthetic primer"
tgacgggacgatagagagaa

SEQ ID NO: 206 - DNA, 20 bp, Artificial Sequence
  source: /note="Description of Artificial Sequence: Synthetic primer"
acaagaccaatcctgtcacc

SEQ ID NO: 207 - DNA, 41 bp, Artificial Sequence
  source: /note="Description of Artificial Sequence: Synthetic primer"
ttcaagtctctgcgcgatctcatgagtcttctaaccgaggt

SEQ ID NO: 208 - DNA, 18 bp, Artificial Sequence
  source: /note="Description of Artificial Sequence: Synthetic primer"
ttggacaaagcgtctacg

SEQ ID NO: 209 - DNA, 39 bp, Artificial Sequence
  source: /note="Description of Artificial Sequence: Synthetic primer"
aagtctctgcgcgatctcgatgagtcttctaaccgaggt

SEQ ID NO: 210 - DNA, 19 bp, Artificial Sequence
  source: /note="Description of Artificial Sequence: Synthetic primer"
tcttctaaccgaggtcgaa

SEQ ID NO: 211 - DNA, 19 bp, Artificial Sequence
  source: /note="Description of Artificial Sequence: Synthetic primer"
ctgctctgtccatgttgtt

SEQ ID NO: 212 - DNA, 42 bp, Artificial Sequence
  source: /note="Description of Artificial Sequence: Synthetic primer"
tcagaggtgacaggattggtctgaagatgtctttgcagggaa

SEQ ID NO: 213 - DNA, 38 bp, Artificial Sequence
  source: /note="Description of Artificial Sequence: Synthetic primer"
ttgtgttcacgctcaccgtcattcccattgagggcatt

SEQ ID NO: 214 - DNA, 22 bp, Artificial Sequence
  source: /note="Description of Artificial Sequence: Synthetic primer"
attccatgagagcctcaagatc

SEQ ID NO: 215 - DNA, 18 bp, Artificial Sequence
  source: /note="Description of Artificial Sequence: Synthetic primer"
gaggactgcagcgtagac

SEQ ID NO: 216 - DNA, 19 bp, Artificial Sequence
  source: /note="Description of Artificial Sequence: Synthetic primer"
ttctctctatcgtcccgtc

SEQ ID NO: 217 - DNA, 41 bp, Artificial Sequence
  source: /note="Description of Artificial Sequence: Synthetic primer"
cccttagtcagaggtgacaggaacacagatcttgaggctct

SEQ ID NO: 218 - DNA, 22 bp, Artificial Sequence
  source: /note="Description of Artificial Sequence: Synthetic primer"
ggtcttgtctttagccattcca

SEQ ID NO: 219 - DNA, 19 bp, Artificial Sequence
  source: /note="Description of Artificial Sequence: Synthetic primer"
gtcttctaaccgaggtcga

SEQ ID NO: 220 - DNA, 41 bp, Artificial Sequence
  source: /note="Description of Artificial Sequence: Synthetic primer"
gaggtgacaggattggtcttgttgaagatgtctttgcaggg

SEQ ID NO: 221 - DNA, 20 bp, Artificial Sequence
  source: /note="Description of Artificial Sequence: Synthetic primer"
aagaagacaagagatatggc

SEQ ID NO: 222 - DNA, 22 bp, Artificial Sequence
  source: /note="Description of Artificial Sequence: Synthetic primer"
caattcgacactaattgatggc

SEQ ID NO: 223 - DNA, 39 bp, Artificial Sequence
  source: /note="Description of Artificial Sequence: Synthetic primer"
gtctccttgcccaattagcaagcatcaatgaactgagca

SEQ ID NO: 224 - DNA, 40 bp, Artificial Sequence
  source: /note="Description of Artificial Sequence: Synthetic primer"
gtggtgttggtaatgaaacgaagctgtctggctgtcagta

SEQ ID NO: 225 - DNA, 20 bp, Artificial Sequence
  source: /note="Description of Artificial Sequence: Synthetic primer"
acattagccttctctccttt

SEQ ID NO: 226 - DNA, 19 bp, Artificial Sequence
  source: /note="Description of Artificial Sequence: Synthetic primer"
aacgggactctagcatact

SEQ ID NO: 227 - DNA, 20 bp, Artificial Sequence
  source: /note="Description of Artificial Sequence: Synthetic primer"
agggacatgaacaacaaaga

SEQ ID NO: 228 - DNA, 19 bp, Artificial Sequence
  source: /note="Description of Artificial Sequence: Synthetic primer"
caagtttagcaacaagcct

SEQ ID NO: 229 - DNA, 49 bp, Artificial Sequence
  source: /note="Description of Artificial Sequence: Synthetic primer"
tcagggacaatacattacgcatatcgataaaggaggaagtaaacactca

SEQ ID NO: 230 - DNA, 43 bp, Artificial Sequence
  source: /note="Description of Artificial Sequence: Synthetic primer"
taaacggaacattcctcaaacaccactctggtcatatgcattc

SEQ ID NO: 231 - DNA, 23 bp, Artificial Sequence
  source: /note="Description of Artificial Sequence: Synthetic primer"
tcaaacggaacttcccttctttc

SEQ ID NO: 232 - DNA, 25 bp, Artificial Sequence
  source: /note="Description of Artificial Sequence: Synthetic primer"
ggatacaagtccttatcaactctgc

SEQ ID NO: 233 - DNA, 22 bp, Artificial Sequence
  source: /note="Description of Artificial Sequence: Synthetic primer"
cttgtaatcaacatcagggtaa

SEQ ID NO: 234 - DNA, 21 bp, Artificial Sequence
  source: /note="Description of Artificial Sequence: Synthetic primer"
agaaacgacaagtagaccatt

SEQ ID NO: 235 - DNA, 43 bp, Artificial Sequence
  source: /note="Description of Artificial Sequence: Synthetic primer"
cgcctcttggatcagacacatgtgttaatacaaaggtacagga

SEQ ID NO: 236 - DNA, 45 bp, Artificial Sequence
  source: /note="Description of Artificial Sequence: Synthetic primer"
cacgctatcatcatcaggggctgcttcaagtgtatataaactcac

SEQ ID NO: 237 - DNA, 23 bp, Artificial Sequence
  source: /note="Description of Artificial Sequence: Synthetic primer"
gagagccatgaagaacaaattct

SEQ ID NO: 238 - DNA, 23 bp, Artificial Sequence
  source: /note="Description of Artificial Sequence: Synthetic primer"
cgaggcttctctttgtttttaat

SEQ ID NO: 239 - RNA, 41 nt, Artificial Sequence
  source: /note="Description of Artificial Sequence: Synthetic oligonucleotide"
uaauuucuacuaaguguagaucuuauaaaagaacuagccaa

SEQ ID NO: 240 - RNA, 41 nt, Artificial Sequence
  source: /note="Description of Artificial Sequence: Synthetic oligonucleotide"
uaauuucuacuaaguguagauacucaauuuccucacuucuc

SEQ ID NO: 241 - RNA, 41 nt, Artificial Sequence
  source: /note="Description of Artificial Sequence: Synthetic oligonucleotide"
uaauuucuacuaaguguagauuguucacgcucaccgugccc

SEQ ID NO: 242 - RNA, 41 nt, Artificial Sequence
  source: /note="Description of Artificial Sequence: Synthetic oligonucleotide"
uaauuucuacuaaguguagaugccauuccaugagagccuca

SEQ ID NO: 243 - RNA, 41 nt, Artificial Sequence
  source: /note="Description of Artificial Sequence: Synthetic oligonucleotide"
uaauuucuacuaaguguagaugacaaagcgucuacgcugca

SEQ ID NO: 244 - RNA, 41 nt, Artificial Sequence
  source: /note="Description of Artificial Sequence: Synthetic oligonucleotide"
uaauuucuacuaaguguagaucuaacacucucagggacaau

SEQ ID NO: 245 - RNA, 41 nt, Artificial Sequence
  source: /note="Description of Artificial Sequence: Synthetic oligonucleotide"
uaauuucuacuaaguguagauagcauuaaaugucaaguucu

SEQ ID NO: 246 - RNA, 41 nt, Artificial Sequence
  source: /note="Description of Artificial Sequence: Synthetic oligonucleotide"
uaauuucuacuaaguguagauagcauuaagugucaaguucu

SEQ ID NO: 247 - RNA, 41 nt, Artificial Sequence
  source: /note="Description of Artificial Sequence: Synthetic oligonucleotide"
uaauuucuacuaaguguagauauuugagcauuaaaugucaa

SEQ ID NO: 248 - RNA, 41 nt, Artificial Sequence
  source: /note="Description of Artificial Sequence: Synthetic oligonucleotide"
uaauuucuacuaaguguagauauuugagcauuaagugucaa

SEQ ID NO: 249 - DNA, 20 bp, Artificial Sequence
  source: /note="Description of Artificial Sequence: Synthetic primer"
atgagtcttctaaccgaggt

SEQ ID NO: 250 - DNA, 21 bp, Artificial Sequence
  source: /note="Description of Artificial Sequence: Synthetic primer"
ttcaagtctctgcgcgatctc

SEQ ID NO: 251 - DNA, 21 bp, Artificial Sequence
  source: /note="Description of Artificial Sequence: Synthetic primer"
ttgaggctctcatggaatggc

SEQ ID NO: 252 - DNA, 20 bp, Artificial Sequence
  source: /note="Description of Artificial Sequence: Synthetic primer"
agcgtgaacacaaatcctaa

SEQ ID NO: 253 - DNA, 20 bp, Artificial Sequence
  source: /note="Description of Artificial Sequence: Synthetic primer"
gaagatgtctttgcagggaa

SEQ ID NO: 254 - DNA, 22 bp, Artificial Sequence
  source: /note="Description of Artificial Sequence: Synthetic primer"
tcagaggtgacaggattggtct

SEQ ID NO: 255 - DNA, 20 bp, Artificial Sequence
  source: /note="Description of Artificial Sequence: Synthetic primer"
ttgtgttcacgctcaccgtg

SEQ ID NO: 256 - DNA, 20 bp, Artificial Sequence
  source: /note="Description of Artificial Sequence: Synthetic primer"
gacttgaagatgtctttgca

SEQ ID NO: 257 - DNA, 17 bp, Artificial Sequence
  source: /note="Description of Artificial Sequence: Synthetic primer"
cagatcttgaggctctc

SEQ ID NO: 258 - DNA, 21 bp, Artificial Sequence
  source: /note="Description of Artificial Sequence: Synthetic primer"
gtcttgtcttgtctttagcca

SEQ ID NO: 259 - DNA, 22 bp, Artificial Sequence
  source: /note="Description of Artificial Sequence: Synthetic primer"
ttagtcagaggtgacaggattg

SEQ ID NO: 260 - DNA, 19 bp, Artificial Sequence
  source: /note="Description of Artificial Sequence: Synthetic primer"
tttggacaaagcgtctacg

SEQ ID NO: 261 - RNA, 24 nt, Artificial Sequence
  source: /note="Description of Artificial Sequence: Synthetic primer"
uuuguguucacgcucaccgugccc

SEQ ID NO: 262 - RNA, 24 nt, Artificial Sequence
  source: /note="Description of Artificial Sequence: Synthetic primer"
uuuagccauuccaugagagccuca

SEQ ID NO: 263 - RNA, 24 nt, Artificial Sequence
  source: /note="Description of Artificial Sequence: Synthetic primer"
uuuggacaaagcgucuacgcugca

SEQ ID NO: 264 - RNA, 41 nt, Artificial Sequence
  source: /note="Description of Artificial Sequence: Synthetic oligonucleotide"
uaauuucuacuaaguguagauaacuugacauuuaaugcuca

SEQ ID NO: 265 - DNA, 43 bp, Artificial Sequence
  source: /note="Description of Artificial Sequence: Synthetic primer"
caaatcttggatcagacacatgtgttaatacaaaggtacagga

SEQ ID NO: 266 - DNA, 43 bp, Artificial Sequence
  source: /note="Description of Artificial Sequence: Synthetic primer"
ccaaacttggatcagacacatgtgttaatacaaaggtacagga

SEQ ID NO: 267 - DNA, 43 bp, Artificial Sequence
  source: /note="Description of Artificial Sequence: Synthetic primer"
cgcaaattggatcagacacatgtgttaatacaaaggtacagga

SEQ ID NO: 268 - DNA, 43 bp, Artificial Sequence
  source: /note="Description of Artificial Sequence: Synthetic primer"
cgccaaatggatcagacacatgtgttaatacaaaggtacagga

SEQ ID NO: 269 - DNA, 43 bp, Artificial Sequence
  source: /note="Description of Artificial Sequence: Synthetic primer"
cgcccaaaggatcagacacatgtgttaatacaaaggtacagga

SEQ ID NO: 270 - DNA, 43 bp, Artificial Sequence
  source: /note="Description of Artificial Sequence: Synthetic primer"
cgcctcaaagatcagacacatgtgttaatacaaaggtacagga

SEQ ID NO: 271 - DNA, 43 bp, Artificial Sequence
  source: /note="Description of Artificial Sequence: Synthetic primer"
cgcctccaaaatcagacacatgtgttaatacaaaggtacagga

SEQ ID NO: 272 - DNA, 43 bp, Artificial Sequence
  source: /note="Description of Artificial Sequence: Synthetic primer"
cgcctctcaaatcagacacatgtgttaatacaaaggtacagga

SEQ ID NO: 273 - DNA, 43 bp, Artificial Sequence
  source: /note="Description of Artificial Sequence: Synthetic primer"
cgcctcttcaaacagacacatgtgttaatacaaaggtacagga

SEQ ID NO: 274 - DNA, 43 bp, Artificial Sequence
  source: /note="Description of Artificial Sequence: Synthetic primer"
cgcctcttgcaaaagacacatgtgttaatacaaaggtacagga

SEQ ID NO: 275 - DNA, 43 bp, Artificial Sequence
  source: /note="Description of Artificial Sequence: Synthetic primer"
cgcctcttggcaaagacacatgtgttaatacaaaggtacagga

SEQ ID NO: 276 - DNA, 43 bp, Artificial Sequence
  source: /note="Description of Artificial Sequence: Synthetic primer"
cgcctcttggacaaaacacatgtgttaatacaaaggtacagga

SEQ ID NO: 277 - DNA, 43 bp, Artificial Sequence
  source: /note="Description of Artificial Sequence: Synthetic primer"
cgcctcttggatcaaacacatgtgttaatacaaaggtacagga

SEQ ID NO: 278 - DNA, 43 bp, Artificial Sequence
  source: /note="Description of Artificial Sequence: Synthetic primer"
cgcctcttggatccaaaacatgtgttaatacaaaggtacagga

SEQ ID NO: 279 - DNA, 43 bp, Artificial Sequence
  source: /note="Description of Artificial Sequence: Synthetic primer"
cgcctcttggatcacaaacatgtgttaatacaaaggtacagga

SEQ ID NO: 280 - DNA, 43 bp, Artificial Sequence
  source: /note="Description of Artificial Sequence: Synthetic primer"
cgcctcttggatcagcaaaatgtgttaatacaaaggtacagga

SEQ ID NO: 281 - DNA, 43 bp, Artificial Sequence
  source: /note="Description of Artificial Sequence: Synthetic primer"
cgcctcttggatcagacaaatgtgttaatacaaaggtacagga

SEQ ID NO: 282 - protein, 1201 aa, Unknown
  source: /note="Description of Unknown: CasY3 sequence"
MKAKKSFYNQKRKFGKRGYRLHDERIAYSGGIGSMRSIKYELKDSYGIAGLRNRIADATISDNKWLYGNINLNDYLEWRSSKTDKQIEDGDRESSLLGFWLEALRLGFVFSKQSHAPNDFNETALQDLFETLDDDLKHVLDRKKWCDFIKIGTPKTNDQGRLKKQIKNLLKGNKREEIEKTLNESDDELKEKINRIADVFAKNKSDKYTIFKLDKPNTEKYPRINDVQVAFFCHPDFEEITERDRTKTLDLIINRFNKRYEITENKKDDKTSNRMALYSLNQGYIPRVLNDLFLFVKDNEDDFSQFLSDLENFFSFSNEQIKIIKERLKKLKKYAEPIPGKPQLADKWDDYASDFGGKLESWYSNRIEKLKKIPESVSDLRNNLEKIRNVLKKQNNASKILELSQKIIEYIRDYGVSFEKPEIIKFSWINKTKDGQKKVFYVAKMADREFIEKLDLWMADLRSQLNEYNQDNKVSFKKKGKKIEELGVLDFALNKAKKNKSTKNENGWQQKLSESIQSAPLFFGEGNRVRNEEVYNLKDLLFSEIKNVENILMSSEAEDLKNIKIEYKEDGAKKGNYVLNVLARFYARFNEDGYGGWNKVKTVLENIAREAGTDFSKYGNNNNRNAGRFYLNGRERQVFTLIKFEKSITVEKILELVKLPSLLDEAYRDLVNENKNHKLRDVIQLSKTIMALVLSHSDKEKQIGGNYIHSKLSGYNALISKRDFISRYSVQTTNGTQCKLAIGKGKSKKGNEIDRYFYAFQFFKNDDSKINLKVIKNNSHKNIDFNDNENKINALQVYSSNYQIQFLDWFFEKHQGKKTSLEVGGSFTIAEKSLTIDWSGSNPRVGFKRSDTEEKRVFVSQPFTLIPDDEDKERRKERMIKTKNRFIGIDIGEYGLAWSLIEVDNGDKNNRGIRQLESGFITDNQQQVLKKNVKSWRQNQIRQTFTSPDTKIARLRESLIGSYKNQLESLMVAKKANLSFEYEVSGFEVGGKRVAKIYDSIKRGSVRKKDNNSQNDQSWGKKGINEWSFETTAAGTSQFCTHCKRWSSLAIVDIEEYELKDYNDNLFKVKINDGEVRLLGKKGWRSGEKIKGKELFGPVKDAMRPNVDGLGMKIVKRKYLKLDLRDWVSRYGNMAIFICPYVDCHHISHADKQAAFNIAVRGYLKSVNPDRAIKHGDKGLSRDFLCQEEGKLNFEQIGLLI

SEQ ID NO: 283 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagautgctcaaatgaaactggcct

SEQ ID NO: 284 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagaugctcaaatgaaactggcctc

SEQ ID NO: 285 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagauctcaaatgaaactggcctcg

SEQ ID NO: 286 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagautcaaatgaaactggcctcgc

SEQ ID NO: 287 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagaucaaatgaaactggcctcgcc

SEQ ID NO: 288 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagauaaatgaaactggcctcgcct

SEQ ID NO: 289 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagauaatgaaactggcctcgcctc

SEQ ID NO: 290 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagauatgaaactggcctcgcctct

SEQ ID NO: 291 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagautgaaactggcctcgcctctt

SEQ ID NO: 292 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagaugaaactggcctcgcctcttg

SEQ ID NO: 293 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagauaaactggcctcgcctcttgg

SEQ ID NO: 294 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagauaactggcctcgcctcttgga

SEQ ID NO: 295 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagauactggcctcgcctcttggat

SEQ ID NO: 296 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagauctggcctcgcctcttggatc

SEQ ID NO: 297 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagautggcctcgcctcttggatca

SEQ ID NO: 298 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagauggcctcgcctcttggatcag

SEQ ID NO: 299 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagaugcctcgcctcttggatcaga

SEQ ID NO: 300 - RNA, 41 nt, Artificial Sequence
  source: /note="Description of Artificial Sequence: Synthetic oligonucleotide"
uaauuucuacuaaguguagauccccuucuacaguggccuua

SEQ ID NO: 301 - RNA, 41 nt, Artificial Sequence
  source: /note="Description of Artificial Sequence: Synthetic oligonucleotide"
uaauuucuacuaaguguagauuccccuucuacaguggccuu

SEQ ID NO: 302 - RNA, 41 nt, Artificial Sequence
  source: /note="Description of Artificial Sequence: Synthetic oligonucleotide"
uaauuucuacuaaguguagauauccccuucuacaguggccu

SEQ ID NO: 303 - RNA, 41 nt, Artificial Sequence
  source: /note="Description of Artificial Sequence: Synthetic oligonucleotide"
uaauuucuacuaaguguagaucauccccuucuacaguggcc

SEQ ID NO: 304 - RNA, 41 nt, Artificial Sequence
  source: /note="Description of Artificial Sequence: Synthetic oligonucleotide"
uaauuucuacuaaguguagauucauccccuucuacaguggc

SEQ ID NO: 305 - RNA, 41 nt, Artificial Sequence
  source: /note="Description of Artificial Sequence: Synthetic oligonucleotide"
uaauuucuacuaaguguagauuucauccccuucuacagugg

SEQ ID NO: 306 - RNA, 41 nt, Artificial Sequence
  source: /note="Description of Artificial Sequence: Synthetic oligonucleotide"
uaauuucuacuaaguguagaucuucauccccuucuacagug

SEQ ID NO: 307 - RNA, 41 nt, Artificial Sequence
  source: /note="Description of Artificial Sequence: Synthetic oligonucleotide"
uaauuucuacuaaguguagaugcuucauccccuucuacagu

SEQ ID NO: 308 - RNA, 41 nt, Artificial Sequence
  source: /note="Description of Artificial Sequence: Synthetic oligonucleotide"
uaauuucuacuaaguguagauugcuucauccccuucuacag

SEQ ID NO: 309 - RNA, 41 nt, Artificial Sequence
  source: /note="Description of Artificial Sequence: Synthetic oligonucleotide"
uaauuucuacuaaguguagaucugcuucauccccuucuaca

SEQ ID NO: 310 - RNA, 41 nt, Artificial Sequence
  source: /note="Description of Artificial Sequence: Synthetic oligonucleotide"
uaauuucuacuaaguguagauccugcuucauccccuucuac

SEQ ID NO: 311 - RNA, 41 nt, Artificial Sequence
  source: /note="Description of Artificial Sequence: Synthetic oligonucleotide"
uaauuucuacuaaguguagauuccugcuucauccccuucua

SEQ ID NO: 312 - RNA, 41 nt, Artificial Sequence
  source: /note="Description of Artificial Sequence: Synthetic oligonucleotide"
uaauuucuacuaaguguagauuuccugcuucauccccuucu

SEQ ID NO: 313 - RNA, 41 nt, Artificial Sequence
  source: /note="Description of Artificial Sequence: Synthetic oligonucleotide"
uaauuucuacuaaguguagauguuccugcuucauccccuuc

SEQ ID NO: 314 - RNA, 41 nt, Artificial Sequence
  source: /note="Description of Artificial Sequence: Synthetic oligonucleotide"
uaauuucuacuaaguguagauuguuccugcuucauccccuu

SEQ ID NO: 315 - RNA, 41 nt, Artificial Sequence
  source: /note="Description of Artificial Sequence: Synthetic oligonucleotide"
uaauuucuacuaaguguagauauguuccugcuucauccccu

SEQ ID NO: 316 - RNA, 41 nt, Artificial Sequence
  source: /note="Description of Artificial Sequence: Synthetic oligonucleotide"
uaauuucuacuaaguguagauuauguuccugcuucaucccc

SEQ ID NO: 317 - RNA, 41 nt, Artificial Sequence
  source: /note="Description of Artificial Sequence: Synthetic oligonucleotide"
uaauuucuacuaaguguagauguauguuccugcuucauccc

SEQ ID NO: 318 - RNA, 41 nt, Artificial Sequence
  source: /note="Description of Artificial Sequence: Synthetic oligonucleotide"
uaauuucuacuaaguguagaugguauguuccugcuucaucc

SEQ ID NO: 319 - RNA, 41 nt, Artificial Sequence
  source: /note="Description of Artificial Sequence: Synthetic oligonucleotide"
uaauuucuacuaaguguagauugguauguuccugcuucauc

SEQ ID NO: 320 - RNA, 41 nt, Artificial Sequence
  source: /note="Description of Artificial Sequence: Synthetic oligonucleotide"
uaauuucuacuaaguguagaugaugaagcaggaacauacca

SEQ ID NO: 321 - RNA, 41 nt, Artificial Sequence
  source: /note="Description of Artificial Sequence: Synthetic oligonucleotide"
uaauuucuacuaaguguagauggaugaagcaggaacauacc

SEQ ID NO: 322 - RNA, 41 nt, Artificial Sequence
  source: /note="Description of Artificial Sequence: Synthetic oligonucleotide"
uaauuucuacuaaguguagaugggaugaagcaggaacauac

SEQ ID NO: 323 - RNA, 41 nt, Artificial Sequence
  source: /note="Description of Artificial Sequence: Synthetic oligonucleotide"
uaauuucuacuaaguguagauggggaugaagcaggaacaua

SEQ ID NO: 324 - RNA, 41 nt, Artificial Sequence
  source: /note="Description of Artificial Sequence: Synthetic oligonucleotide"
uaauuucuacuaaguguagauaggggaugaagcaggaacau

SEQ ID NO: 325 - RNA, 41 nt, Artificial Sequence
  source: /note="Description of Artificial Sequence: Synthetic oligonucleotide"
uaauuucuacuaaguguagauaaggggaugaagcaggaaca

SEQ ID NO: 326 - RNA, 41 nt, Artificial Sequence
  source: /note="Description of Artificial Sequence: Synthetic oligonucleotide"
uaauuucuacuaaguguagaugaaggggaugaagcaggaac

SEQ ID NO: 327 - RNA, 41 nt, Artificial Sequence
  source: /note="Description of Artificial Sequence: Synthetic oligonucleotide"
uaauuucuacuaaguguagauagaaggggaugaagcaggaa

SEQ ID NO: 328 - RNA, 41 nt, Artificial Sequence
  source: /note="Description of Artificial Sequence: Synthetic oligonucleotide"
uaauuucuacuaaguguagauuagaaggggaugaagcagga

SEQ ID NO: 329 - RNA, 41 nt, Artificial Sequence
  source: /note="Description of Artificial Sequence: Synthetic oligonucleotide"
uaauuucuacuaaguguagauguagaaggggaugaagcagg

SEQ ID NO: 330 - RNA, 41 nt, Artificial Sequence
  source: /note="Description of Artificial Sequence: Synthetic oligonucleotide"
uaauuucuacuaaguguagauuguagaaggggaugaagcag

SEQ ID NO: 331 - RNA, 41 nt, Artificial Sequence
  source: /note="Description of Artificial Sequence: Synthetic oligonucleotide"
uaauuucuacuaaguguagaucuguagaaggggaugaagca

SEQ ID NO: 332 - RNA, 41 nt, Artificial Sequence
  source: /note="Description of Artificial Sequence: Synthetic oligonucleotide"
uaauuucuacuaaguguagauacuguagaaggggaugaagc

SEQ ID NO: 333 - RNA, 41 nt, Artificial Sequence
  source: /note="Description of Artificial Sequence: Synthetic oligonucleotide"
uaauuucuacuaaguguagaucacuguagaaggggaugaag

SEQ ID NO: 334 - RNA, 41 nt, Artificial Sequence
  source: /note="Description of Artificial Sequence: Synthetic oligonucleotide"
uaauuucuacuaaguguagauccacuguagaaggggaugaa

SEQ ID NO: 335 - RNA, 41 nt, Artificial Sequence
  source: /note="Description of Artificial Sequence: Synthetic oligonucleotide"
uaauuucuacuaaguguagaugccacuguagaaggggauga

SEQ ID NO: 336 - RNA, 41 nt, Artificial Sequence
  source: /note="Description of Artificial Sequence: Synthetic oligonucleotide"
uaauuucuacuaaguguagauggccacuguagaaggggaug

SEQ ID NO: 337 - RNA, 41 nt, Artificial Sequence
  source: /note="Description of Artificial Sequence: Synthetic oligonucleotide"
uaauuucuacuaaguguagauaggccacuguagaaggggau

SEQ ID NO: 338 - RNA, 41 nt, Artificial Sequence
  source: /note="Description of Artificial Sequence: Synthetic oligonucleotide"
uaauuucuacuaaguguagauaaggccacuguagaagggga

SEQ ID NO: 339 - RNA, 41 nt, Artificial Sequence
  source: /note="Description of Artificial Sequence: Synthetic oligonucleotide"
uaauuucuacuaaguguagauuaaggccacuguagaagggg

SEQ ID NO: 340 - RNA, 41 nt, Artificial Sequence
  source: /note="Description of Artificial Sequence: Synthetic oligonucleotide"
uaauuucuacuaaguguagaugcccuucuacaguggccuua

SEQ ID NO: 341 - RNA, 41 nt, Artificial Sequence
  source: /note="Description of Artificial Sequence: Synthetic oligonucleotide"
uaauuucuacuaaguguagauugcccuucuacaguggccuu

SEQ ID NO: 342 - RNA, 41 nt, Artificial Sequence
  source: /note="Description of Artificial Sequence: Synthetic oligonucleotide"
uaauuucuacuaaguguagauaugcccuucuacaguggccu

SEQ ID NO: 343 - RNA, 41 nt, Artificial Sequence
  source: /note="Description of Artificial Sequence: Synthetic oligonucleotide"
uaauuucuacuaaguguagaucaugcccuucuacaguggcc

SEQ ID NO: 344 - RNA, 41 nt, Artificial Sequence
  source: /note="Description of Artificial Sequence: Synthetic oligonucleotide"
uaauuucuacuaaguguagauucaugcccuucuacaguggc

SEQ ID NO: 345 - RNA, 41 nt, Artificial Sequence
  source: /note="Description of Artificial Sequence: Synthetic oligonucleotide"
uaauuucuacuaaguguagauuucaugcccuucuacagugg

SEQ ID NO: 346 - RNA, 41 nt, Artificial Sequence
  source: /note="Description of Artificial Sequence: Synthetic oligonucleotide"
uaauuucuacuaaguguagaucuucaugcccuucuacagug

SEQ ID NO: 347 - RNA, 41 nt, Artificial Sequence
  source: /note="Description of Artificial Sequence: Synthetic oligonucleotide"
uaauuucuacuaaguguagaugcuucaugcccuucuacagu

SEQ ID NO: 348 - RNA, 41 nt, Artificial Sequence
  source: /note="Description of Artificial Sequence: Synthetic oligonucleotide"
uaauuucuacuaaguguagauugcuucaugcccuucuacag

SEQ ID NO: 349 - RNA, 41 nt, Artificial Sequence
  source: /note="Description of Artificial Sequence: Synthetic oligonucleotide"
uaauuucuacuaaguguagaucugcuucaugcccuucuaca

SEQ ID NO: 350 - RNA, 41 nt, Artificial Sequence
  source: /note="Description of Artificial Sequence: Synthetic oligonucleotide"
uaauuucuacuaaguguagauccugcuucaugcccuucuac

SEQ ID NO: 351 - RNA, 41 nt, Artificial Sequence
  source: /note="Description of Artificial Sequence: Synthetic oligonucleotide"
uaauuucuacuaaguguagauuccugcuucaugcccuucua

SEQ ID NO: 352 - RNA, 41 nt, Artificial Sequence
  source: /note="Description of Artificial Sequence: Synthetic oligonucleotide"
uaauuucuacuaaguguagauuuccugcuucaugcccuucu

SEQ ID NO: 353 - RNA, 41 nt, Artificial Sequence
  source: /note="Description of Artificial Sequence: Synthetic oligonucleotide"
uaauuucuacuaaguguagauguuccugcuucaugcccuuc

SEQ ID NO: 354 - RNA, 41 nt, Artificial Sequence
  source: /note="Description of Artificial Sequence: Synthetic oligonucleotide"
uaauuucuacuaaguguagauuguuccugcuucaugcccuu

SEQ ID NO: 355 - RNA, 41 nt, Artificial Sequence
  source: /note="Description of Artificial Sequence: Synthetic oligonucleotide"
uaauuucuacuaaguguagauauguuccugcuucaugcccu

SEQ ID NO: 356 - RNA, 41 nt, Artificial Sequence
  source: /note="Description of Artificial Sequence: Synthetic oligonucleotide"
uaauuucuacuaaguguagauuauguuccugcuucaugccc

SEQ ID NO: 357 - RNA, 41 nt, Artificial Sequence
  source: /note="Description of Artificial Sequence: Synthetic oligonucleotide"
uaauuucuacuaaguguagauguauguuccugcuucaugcc

SEQ ID NO: 358 - RNA, 41 nt, Artificial Sequence
  source: /note="Description of Artificial Sequence: Synthetic oligonucleotide"
uaauuucuacuaaguguagaugguauguuccugcuucaugc

SEQ ID NO: 359 - RNA, 41 nt, Artificial Sequence
  source: /note="Description of Artificial Sequence: Synthetic oligonucleotide"
uaauuucuacuaaguguagauugguauguuccugcuucaug

SEQ ID NO: 360 - RNA, 41 nt, Artificial Sequence
  source: /note="Description of Artificial Sequence: Synthetic oligonucleotide"
uaauuucuacuaaguguagaucaugaagcaggaacauacca

SEQ ID NO: 361 - RNA, 41 nt, Artificial Sequence
  source: /note="Description of Artificial Sequence: Synthetic oligonucleotide"
uaauuucuacuaaguguagaugcaugaagcaggaacauacc

SEQ ID NO: 362 - RNA, 41 nt, Artificial Sequence
  source: /note="Description of Artificial Sequence: Synthetic oligonucleotide"
uaauuucuacuaaguguagauggcaugaagcaggaacauac

SEQ ID NO: 363 - RNA, 41 nt, Artificial Sequence
  source: /note="Description of Artificial Sequence: Synthetic oligonucleotide"
uaauuucuacuaaguguagaugggcaugaagcaggaacaua

SEQ ID NO: 364 - RNA, 41 nt, Artificial Sequence
  source: /note="Description of Artificial Sequence: Synthetic oligonucleotide"
uaauuucuacuaaguguagauagggcaugaagcaggaacau

SEQ ID NO: 365 - RNA, 41 nt, Artificial Sequence
  source: /note="Description of Artificial Sequence: Synthetic oligonucleotide"
uaauuucuacuaaguguagauaagggcaugaagcaggaaca

SEQ ID NO: 366 - RNA, 41 nt, Artificial Sequence
  source: /note="Description of Artificial Sequence: Synthetic oligonucleotide"
uaauuucuacuaaguguagaugaagggcaugaagcaggaac

SEQ ID NO: 367 - RNA, 41 nt, Artificial Sequence
  source: /note="Description of Artificial Sequence: Synthetic oligonucleotide"
uaauuucuacuaaguguagauagaagggcaugaagcaggaa

SEQ ID NO: 368 - RNA, 41 nt, Artificial Sequence
  source: /note="Description of Artificial Sequence: Synthetic oligonucleotide"
uaauuucuacuaaguguagauuagaagggcaugaagcagga

SEQ ID NO: 369 - RNA, 41 nt, Artificial Sequence
  source: /note="Description of Artificial Sequence: Synthetic oligonucleotide"
uaauuucuacuaaguguagauguagaagggcaugaagcagg

SEQ ID NO: 370 - RNA, 41 nt, Artificial Sequence
  source: /note="Description of Artificial Sequence: Synthetic oligonucleotide"
uaauuucuacuaaguguagauuguagaagggcaugaagcag

SEQ ID NO: 371 - RNA, 41 nt, Artificial Sequence
  source: /note="Description of Artificial Sequence: Synthetic oligonucleotide"
uaauuucuacuaaguguagaucuguagaagggcaugaagca

SEQ ID NO: 372 - RNA, 41 nt, Artificial Sequence
  source: /note="Description of Artificial Sequence: Synthetic oligonucleotide"
uaauuucuacuaaguguagauacuguagaagggcaugaagc

SEQ ID NO: 373 - RNA, 41 nt, Artificial Sequence
  source: /note="Description of Artificial Sequence: Synthetic oligonucleotide"
uaauuucuacuaaguguagaucacuguagaagggcaugaag

SEQ ID NO: 374 - RNA, 41 nt, Artificial Sequence
  source: /note="Description of Artificial Sequence: Synthetic oligonucleotide"
uaauuucuacuaaguguagauccacuguagaagggcaugaa

SEQ ID NO: 375 - RNA, 41 nt, Artificial Sequence
  source: /note="Description of Artificial Sequence: Synthetic oligonucleotide"
uaauuucuacuaaguguagaugccacuguagaagggcauga

SEQ ID NO: 376 - RNA, 41 nt, Artificial Sequence
  source: /note="Description of Artificial Sequence: Synthetic oligonucleotide"
uaauuucuacuaaguguagauggccacuguagaagggcaug

SEQ ID NO: 377 - RNA, 41 nt, Artificial Sequence
  source: /note="Description of Artificial Sequence: Synthetic oligonucleotide"
uaauuucuacuaaguguagauaggccacuguagaagggcau

SEQ ID NO: 378 - RNA, 41 nt, Artificial Sequence
  source: /note="Description of Artificial Sequence: Synthetic oligonucleotide"
uaauuucuacuaaguguagauaaggccacuguagaagggca

SEQ ID NO: 379 - RNA, 41 nt, Artificial Sequence
  source: /note="Description of Artificial Sequence: Synthetic oligonucleotide"
uaauuucuacuaaguguagauuaaggccacuguagaagggc

SEQ ID NO: 380 - RNA, 76 nt, Artificial Sequence
  source: /note="Description of Artificial Sequence: Synthetic oligonucleotide"
guuucaaagauuaaauaauuucuacuaaguguagauuccugcagcagaaaaucaaagacaaugaauauuucggcgc

SEQ ID NO: 381 - DNA, 4 bp, Unknown
  source: /note="Description of Unknown: PAM sequence"
tttt

SEQ ID NO: 382 - DNA, 4 bp, Unknown
  source: /note="Description of Unknown: PAM sequence"
tttg

SEQ ID NO: 383 - DNA, 4 bp, Unknown
  source: /note="Description of Unknown: PAM sequence"
tttc

SEQ ID NO: 384 - DNA, 4 bp, Unknown
  source: /note="Description of Unknown: PAM sequence"
ttta

SEQ ID NO: 385 - DNA, 4 bp, Unknown
  source: /note="Description of Unknown: PAM sequence"
ttga

SEQ ID NO: 386 - DNA, 4 bp, Unknown
  source: /note="Description of Unknown: PAM sequence"
ttca

SEQ ID NO: 387 - DNA, 4 bp, Unknown
  source: /note="Description of Unknown: PAM sequence"
ttaa

SEQ ID NO: 388 - DNA, 4 bp, Unknown
  source: /note="Description of Unknown: PAM sequence"
tgta

SEQ ID NO: 389 - DNA, 4 bp, Unknown
  source: /note="Description of Unknown: PAM sequence"
tcta

SEQ ID NO: 390 - DNA, 4 bp, Unknown
  source: /note="Description of Unknown: PAM sequence"
tata

SEQ ID NO: 391 - DNA, 4 bp, Unknown
  source: /note="Description of Unknown: PAM sequence"
gtta

SEQ ID NO: 392 - DNA, 4 bp, Unknown
  source: /note="Description of Unknown: PAM sequence"
ctta

SEQ ID NO: 393 - DNA, 4 bp, Unknown
  source: /note="Description of Unknown: PAM sequence"
atta

SEQ ID NO: 394 - DNA, 22 bp, Artificial Sequence
  source: /note="Description of Artificial Sequence: Synthetic primer"
tcacctccaccgtgtttctcat

SEQ ID NO: 395 - DNA, 23 bp, Artificial Sequence
  source: /note="Description of Artificial Sequence: Synthetic primer"
tcacctccaccgtgtttctcatc

SEQ ID NO: 396 - DNA, 24 bp, Artificial Sequence
  source: /note="Description of Artificial Sequence: Synthetic primer"
tcacctccaccgtgtttctcatca

SEQ ID NO: 397 - DNA, 26 bp, Artificial Sequence
  source: /note="Description of Artificial Sequence: Synthetic primer"
ggagccaatattgtctttgtgttccc

SEQ ID NO: 398 - DNA, 18 bp, Artificial Sequence
  source: /note="Description of Artificial Sequence: Synthetic primer"
tcatcacgcagctcatgc

SEQ ID NO: 399 - DNA, 41 bp, Artificial Sequence
  source: /note="Description of Artificial Sequence: Synthetic oligonucleotide"
taatttctactaagtgtagatcatcacgcagctcatgccct

SEQ ID NO: 400 - DNA, 41 bp, Artificial Sequence
  source: /note="Description of Artificial Sequence: Synthetic oligonucleotide"
taatttctactaagtgtagattcatcacgcagctcatgccc

SEQ ID NO: 401 - DNA, 41 bp, Artificial Sequence
  source: /note="Description of Artificial Sequence: Synthetic oligonucleotide"
taatttctactaagtgtagatctcatcacgcagctcatgcc

SEQ ID NO: 402 - DNA, 41 bp, Artificial Sequence
  source: /note="Description of Artificial Sequence: Synthetic oligonucleotide"
taatttctactaagtgtagatcatcatgcagctcatgccct

SEQ ID NO: 403 - DNA, 41 bp, Artificial Sequence
  source: /note="Description of Artificial Sequence: Synthetic oligonucleotide"
taatttctactaagtgtagattcatcatgcagctcatgccc

SEQ ID NO: 404 - DNA, 41 bp, Artificial Sequence
  source: /note="Description of Artificial Sequence: Synthetic oligonucleotide"
taatttctactaagtgtagatctcatcatgcagctcatgcc

SEQ ID NO: 405 - protein, 534 aa, Unknown
  source: /note="Description of Unknown: Cas14 sequence"
NASINLGKRAINLSANYDSNLVIGCKNCKFLSFNGNFPRQTNVREGCHSCDKSTYAPEVYIVKIGERKAKYDVLDSLKKFTFQSLKYQIKKSMRERSKKPKELLEFVIFANKDKAFNVIQKSYEHLILNIKQEINRMNGKKRIKNHKKRLFKDREKQLNKLRLIGSSSLFFPRENKGDKDLFTYVAIHSVGRDIGVAGSYESHIEPISDLTYQLFINNEKRLLYAYKPKQNKIIELKENLWNLKKEKKPLDLEFTKPLEKSITFSVKNDKLFKVSKDLMLRQAKFNIQGKEKLSKEERQINRDFSKIKSNVISLSYGRFEELKKEKNIWSPHIYREVKQKEIKPCIVRKGDRIELFEQLKRKMDKLKKFRKERQKKISKDLNFAERIAYNFHTKSIKNTSNKINIDQEAKRGKASYMRKRIGNESFRKKYCEQCFSVGNVYHNVQNGCSCFDNPIELIKKGDEGLIPKGKEDRKYKGALRDDNLQMQIIRVAFNIAKGYEDFYNNLKEKTEKDLKLKFKIGTTISTQESNNKEM

SEQ ID NO: 406 - DNA, 23 bp, Artificial Sequence
  source: /note="Description of Artificial Sequence: Synthetic primer"
tatatggtagaatcctgcttctc

SEQ ID NO: 407 - DNA, 20 bp, Unknown
  source: /note="Description of Unknown: target sequence"
tctacgctgcagtcctcgct

SEQ ID NO: 408 - DNA, 55 bp, Artificial Sequence
  source: /note="Description of Artificial Sequence: Synthetic primer"
  source: /note="Description of Combined DNA/RNA Molecule: Synthetic primer"
ctccaccgtgcuuugcaucacgcagcucaugcccuutcggcgcctcctggactat

SEQ ID NO: 409 - DNA, 55 bp, Artificial Sequence
  source: /note="Description of Artificial Sequence: Synthetic primer"
  source: /note="Description of Combined DNA/RNA Molecule: Synthetic primer"
atagtccaggaggcagccgaagggcaugagcugcgugaugcaaagcacggtggag

SEQ ID NO: 410 - DNA, 55 bp, Artificial Sequence
  source: /note="Description of Artificial Sequence: Synthetic primer"
  source: /note="Description of Combined DNA/RNA Molecule: Synthetic primer"
ctccaccgtgctttgcaucacgcagcucaugcccuutcggcgcctcctggactat

SEQ ID NO: 411 - DNA, 55 bp, Artificial Sequence; identical to SEQ ID NO: 409
  source: /note="Description of Artificial Sequence: Synthetic primer"
  source: /note="Description of Combined DNA/RNA Molecule: Synthetic primer"

SEQ ID NO: 412 - DNA, 1109 bp, Homo sapiens
tgcctgctgactgctctgtagcacagtgcttcgcaaagtgtgatcctgggaccagcagagcagcagctcctttgagcttattggaatggcagaccctcaggtcccacctctgacctgctgcatgggaattctggggagggacgcagaatctctggttccacaggctctccggtgatgctaatgaataccggcatttgaacagcaccgatctagcccctttcagtccatgagccaacaacccttggtcctgtctgtggtgacccagtgtgactctcatggggagcaaggagaggaagttgaagttcactgacagggttgttaaggggattatgcaatagatgagacccatgggcctgaagtccgagggtgtatgttagttccccgttcttttgacccatggattaacctactctgtgcaaagggcattttcaagtttgttgccctgctcacttggagaaagcttatgaaggatcaggaaaattaaaagggtgctctcgcctataacttctctctcctttgctttcacaggccttggtatgttcctgcttcatgcctttctacagtggccttatccctccttccttcagaggcgtggtaagtcggctttctctgctagcgctgagtcctgggggcctctgaagtgtgctcacacatctcctgcctgcagggcactggtgtcgggcacctcagggtctgtcccatggtggagccccatgcctcactgcctttcagacagagtagccacagctggccctatttccaggctacccgggcagcaaaacttactgcatgtgtaattaattatttggctatctgtaaggtaaactggctggttcacttaatctgcaccttaagcatcagatagcttctcagtgatctagttaaactatatgatgttggccaggcgcggtggctcatgtctgtaatcccagcactttgggagcctgaagcaggcagatcacttgaggtcaggagttcgagaccagcctggccaacagtgtgaaactctgtctctcctaaaaatacaaaaattagctgggcatggtggtgtgcacctgtaatcccagctgctcgggaggctgaggcaggagaattgcttgaacttggga

SEQ ID NO: 413 - DNA, 1109 bp, Homo sapiens
tgcctgctgactgctctgtagcacagtgcttcgcaaagtgtgatcctgggaccagcagagcagcagctcctttgagcttattggaatggcagaccctcaggtcccacctctgacctgctgcatgggaattctggggagggacgcagaatctctggttccacaggctctccggtgatgctaatgaataccggcatttgaacagcaccgatctagcccctttcagtccatgagccaacaacccttggtcctgtctgtggtgacccagtgtgactctcatggggagcaaggagaggaagttgaagttcactgacagggttgttaaggggattatgcaatagatgagacccatgggcctgaagtccgagggtgtatgttagttccccgttcttttgacccatggattaacctactctgtgcaaagggcattttcaagtttgttgccctgctcacttggagaaagcttatgaaggatcaggaaaattaaaagggtgctctcgcctataacttctctctcctttgctttcacaggccttggtatgttcctgcttcatccctttctacagtggccttatccctccttccttcagaggcgtggtaagtcggctttctctgctagcgctgagtcctgggggcctctgaagtgtgctcacacatctcctgcctgcagggcactggtgtcgggcacctcagggtctgtcccatggtggagccccatgcctcactgcctttcagacagagtagccacagctggccctatttccaggctacccgggcagcaaaacttactgcatgtgtaattaattatttggctatctgtaaggtaaactggctggttcacttaatctgcaccttaagcatcagatagcttctcagtgatctagttaaactatatgatgttggccaggcgcggtggctcatgtctgtaatcccagcactttgggagcctgaagcaggcagatcacttgaggtcaggagttcgagaccagcctggccaacagtgtgaaactctgtctctcctaaaaatacaaaaattagctgggcatggtggtgtgcacctgtaatcccagctgctcgggaggctgaggcaggagaattgcttgaacttggga

SEQ ID NO: 414 - DNA, 1109 bp, Homo sapiens
tgcctgctgactgctctgtagcacagtgcttcgcaaagtgtgatcctgggaccagcagagcagcagctcctttgagcttattggaatggcagaccctcaggtcccacctctgacctgctgcatgggaattctggggagggacgcagaatctctggttccacaggctctccggtgatgctaatgaataccggcatttgaacagcaccgatctagcccctttcagtccatgagccaacaacccttggtcctgtctgtggtgacccagtgtgactctcatggggagcaaggagaggaagttgaagttcactgacagggttgttaaggggattatgcaatagatgagacccatgggcctgaagtccgagggtgtatgttagttccccgttcttttgacccatggattaacctactctgtgcaaagggcattttcaagtttgttgccctgctcacttggagaaagcttatgaaggatcaggaaaattaaaagggtgctctcgcctataacttctctctcctttgctttcacaggccttggtatgttcctgcttcatgcccttctacagtggccttatccctccttccttcagaggcgtggtaagtcggctttctctgctagcgctgagtcctgggggcctctgaagtgtgctcacacatctcctgcctgcagggcactggtgtcgggcacctcagggtctgtcccatggtggagccccatgcctcactgcctttcagacagagtagccacagctggccctatttccaggctacccgggcagcaaaacttactgcatgtgtaattaattatttggctatctgtaaggtaaactggctggttcacttaatctgcaccttaagcatcagatagcttctcagtgatctagttaaactatatgatgttggccaggcgcggtggctcatgtctgtaatcccagcactttgggagcctgaagcaggcagatcacttgaggtcaggagttcgagaccagcctggccaacagtgtgaaactctgtctctcctaaaaatacaaaaattagctgggcatggtggtgtgcacctgtaatcccagctgctcgggaggctgaggcaggagaattgcttgaacttggga

SEQ ID NO: 415 - DNA, 1109 bp, Homo sapiens
tgcctgctgactgctctgtagcacagtgcttcgcaaagtgtgatcctgggaccagcagagcagcagctcctttgagcttattggaatggcagaccctcaggtcccacctctgacctgctgcatgggaattctggggagggacgcagaatctctggttccacaggctctccggtgatgctaatgaataccggcatttgaacagcaccgatctagcccctttcagtccatgagccaacaacccttggtcctgtctgtggtgacccagtgtgactctcatggggagcaaggagaggaagttgaagttcactgacagggttgttaaggggattatgcaatagatgagacccatgggcctgaagtccgagggtgtatgttagttccccgttcttttgacccatggattaacctactctgtgcaaagggcattttcaagtttgttgccctgctcacttggagaaagcttatgaaggatcaggaaaattaaaagggtgctctcgcctataacttctctctcctttgctttcacaggccttggtatgttcctgcttcatccccttctacagtggccttatccctccttccttcagaggcgtggtaagtcggctttctctgctagcgctgagtcctgggggcctctgaagtgtgctcacacatctcctgcctgcagggcactggtgtcgggcacctcagggtctgtcccatggtggagccccatgcctcactgcctttcagacagagtagccacagctggccctatttccaggctacccgggcagcaaaacttactgcatgtgtaattaattatttggctatctgtaaggtaaactggctggttcacttaatctgcaccttaagcatcagatagcttctcagtgatctagttaaactatatgatgttggccaggcgcggtggctcatgtctgtaatcccagcactttgggagcctgaagcaggcagatcacttgaggtcaggagttcgagaccagcctggccaacagtgtgaaactctgtctctcctaaaaatacaaaaattagctgggcatggtggtgtgcacctgtaatcccagctgctcgggaggctgaggcaggagaattgcttgaacttggga

SEQ ID NO: 416 - DNA, 20 bp, Homo sapiens
tcgtaattcacagttcaaga

SEQ ID NO: 417 - DNA, 20 bp, Homo sapiens
ctgcaggcatacactgaagt

SEQ ID NO: 418 - RNA, 51 nt, Artificial Sequence
  source: /note="Description of Artificial Sequence: Synthetic oligonucleotide"
ggccaccccaaaaaugaaggggacuaaaacacuucugaguucggaauggug

SEQ ID NO: 419 - RNA, 51 nt, Artificial Sequence
  source: /note="Description of Artificial Sequence: Synthetic oligonucleotide"
ggccaccccaaaaaugaaggggacuaaaacaacguauucacggcguuaugg

SEQ ID NO: 420 - RNA, 51 nt, Artificial Sequence
  source: /note="Description of Artificial Sequence: Synthetic oligonucleotide"
ggccaccccaaaaaugaaggggacuaaaacagugauaaguggaaugccaug

SEQ ID NO: 421 - RNA, 41 nt, Artificial Sequence
  source: /note="Description of Artificial Sequence: Synthetic oligonucleotide"
uaauuucuacuaaguguagauucccuuucuacaguggccuu

SEQ ID NO: 422 - RNA, 41 nt, Artificial Sequence
  source: /note="Description of Artificial Sequence: Synthetic oligonucleotide"
uaauuucuacuaaguguagauugccuuucuacaguggccuu

SEQ ID NO: 423 - RNA, 41 nt, Artificial Sequence
  source: /note="Description of Artificial Sequence: Synthetic oligonucleotide"
uaauuucuacuaaguguagauucaucacgcagcucaugccc

SEQ ID NO: 424 - RNA, 56 nt, Artificial Sequence
  source: /note="Description of Artificial Sequence: Synthetic oligonucleotide"
guuugguaccuuuauuaauuucuacuaaguguagauucaucacgcagcucaugccc

SEQ ID NO: 425 - RNA, 41 nt, Artificial Sequence
  source: /note="Description of Artificial Sequence: Synthetic oligonucleotide"
uaauuucuacuaaguguagauacuucaguguaugccugcag

SEQ ID NO: 426 - RNA, 41 nt, Artificial Sequence
  source: /note="Description of Artificial Sequence: Synthetic oligonucleotide"
uaauuucuacuaaguguagauacuuuaguguaugccugcag

SEQ ID NO: 427 - RNA, 56 nt, Artificial Sequence
  source: /note="Description of Artificial Sequence: Synthetic oligonucleotide"
guuugguaccuuuauuaauuucuacuaaguguagauggcaggccaaacugcugggu

SEQ ID NO: 428 - RNA, 56 nt, Artificial Sequence
  source: /note="Description of Artificial Sequence: Synthetic oligonucleotide"
guuugguaccuuuauuaauuucuacuaaguguagauggccggccaaacugcugggu

SEQ ID NO: 429 - RNA, 56 nt, Artificial Sequence
  source: /note="Description of Artificial Sequence: Synthetic oligonucleotide"
guuugguaccuuuauuaauuucuacuaaguguagauggcgggccaaacugcugggu

SEQ ID NO: 430 - RNA, 56 nt, Artificial Sequence
  source: /note="Description of Artificial Sequence: Synthetic oligonucleotide"
guuugguaccuuuauuaauuucuacuaaguguagauggcuggccaaacugcugggu

SEQ ID NO: 431 - DNA, 55 bp, Unknown
  source: /note="Description of Unknown: T-SNP Target Strand sequence"
tggtattctttctcttccgcacccagcagtttggccagcccaaaatctgtgatct

SEQ ID NO: 432 - DNA, 55 bp, Unknown
  source: /note="Description of Unknown: T-SNP Non-Target Strand sequence"
agatcacagattttgggctggccaaactgctgggtgcggaagagaaagaatacca

SEQ ID NO: 433 - DNA, 55 bp, Unknown
  source: /note="Description of Unknown: G-SNP Target Strand sequence"
tggtattctttctcttccgcacccagcagtttggcccgcccaaaatctgtgatct

SEQ ID NO: 434 - DNA, 55 bp, Unknown
  source: /note="Description of Unknown: G-SNP Non-Target Strand sequence"
agatcacagattttgggcgggccaaactgctgggtgcggaagagaaagaatacca

SEQ ID NO: 435 - DNA, 55 bp, Unknown
  source: /note="Description of Unknown: C-SNP Target Strand sequence"
tggtattctttctcttccgcacccagcagtttggccggcccaaaatctgtgatct

SEQ ID NO: 436 - DNA, 55 bp, Unknown
  source: /note="Description of Unknown: C-SNP Non-Target Strand sequence"
agatcacagattttgggccggccaaactgctgggtgcggaagagaaagaatacca

SEQ ID NO: 437 - DNA, 55 bp, Unknown
  source: /note="Description of Unknown: A-SNP Target Strand sequence"
tggtattctttctcttccgcacccagcagtttggcctgcccaaaatctgtgatct

SEQ ID NO: 438 - DNA, 55 bp, Unknown
  source: /note="Description of Unknown: A-SNP Non-Target Strand sequence"
agatcacagattttgggcaggccaaactgctgggtgcggaagagaaagaatacca

SEQ ID NO: 439 - RNA, 41 nt, Artificial Sequence
  source: /note="Description of Artificial Sequence: Synthetic oligonucleotide"
uaauuucuacuaaguguagauucaucaugcagcucaugccc

SEQ ID NO: 440 - DNA, 20 bp, Artificial Sequence
  source: /note="Description of Artificial Sequence: Synthetic oligonucleotide"
gggcatgagctgcgtgatga

SEQ ID NO: 441 - DNA, 20 bp, Artificial Sequence
  source: /note="Description of Artificial Sequence: Synthetic oligonucleotide"
gggcatgagctgcatgatga

SEQ ID NO: 442 - DNA, 20 bp, Artificial Sequence
  source: /note="Description of Artificial Sequence: Synthetic primer"
accacatgcaggaaggtcag

SEQ ID NO: 443 - DNA, 19 bp, Artificial Sequence
  source: /note="Description of Artificial Sequence: Synthetic primer"
agaaggactccattgctgc

SEQ ID NO: 444 - DNA, 990 bp, Homo sapiens
tggtccccgccaccccccacccccactttgcagataaaccacatgcaggaaggtcagcctggcaagtccagtaagttcaagcccaggtctcaactgggcagcagagctcctgctcttctttgtcctcatatacgagcacctctggacttaaaacttgaggaactggatggagaaaagttaatggtcagcagcgggttacatcttctttcatgcgcctttccattctttggatcagtagtcactaacgttcgccagccataagtcctcgacgtggagaggctcagagcctggcatgaacatgaccctgaattcggatgcagagcttcttcccatgatgatctgtccctcacagcagggtcttctctgtttcagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtaaggaggtggctttaggtcagccagcattttcctgacaccagggaccaggctgccttcccactagctgtattgtttaacacatgcaggggaggatgctctccagacattctgggtgagctcgcagcagctgctgctggcagctgggtccagccagggtctcctggtagtgtgagccagagctgctttgggaacagtacttgctgggacagtgaatgaggatgttatccccaggtgatcattagcaaatgttaggtttcagtctctccctgcaggatatataagtccccttcaatagcgcaattgggaaaggtcacagctgccttggtggtccactgctgtcaaggacacctaaggaacaggaaaggccccatgcggacccgagctcccagggctgtctgtggctcgtggctgggacaggcagcaatggagtccttctctcccttcactggctcggtttct

SEQ ID NO: 445 - DNA, 990 bp, Homo sapiens
tggtccccgccaccccccacccccactttgcagataaaccacatgcaggaaggtcagcctggcaagtccagtaagttcaagcccaggtctcaactgggcagcagagctcctgctcttctttgtcctcatatacgagcacctctggacttaaaacttgaggaactggatggagaaaagttaatggtcagcagcgggttacatcttctttcatgcgcctttccattctttggatcagtagtcactaacgttcgccagccataagtcctcgacgtggagaggctcagagcctggcatgaacatgaccctgaattcggatgcagagcttcttcccatgatgatctgtccctcacagcagggtcttctctgtttcagggcatgaactacttggaggaccgtcgcttggtgcaccgcgacctggcagccaggaacgtactggtgaaaacaccgcagcatgtcaagatcacagattttgggcaggccaaactgctgggtgcggaagagaaagaataccatgcagaaggaggcaaagtaaggaggtggctttaggtcagccagcattttcctgacaccagggaccaggctgccttcccactagctgtattgtttaacacatgcaggggaggatgctctccagacattctgggtgagctcgcagcagctgctgctggcagctgggtccagccagggtctcctggtagtgtgagccagagctgctttgggaacagtacttgctgggacagtgaatgaggatgttatccccaggtgatcattagcaaatgttaggtttcagtctctccctgcaggatatataagtccccttcaatagcgcaattgggaaaggtcacagctgccttggtggtccactgctgtcaaggacacctaaggaacaggaaaggccccatgcggacccgagctcccagggctgtctgtggctcgtggctgggacaggcagcaatggagtccttctctcccttcactggctcggtttct

SEQ ID NO: 446 - DNA, 990 bp, Homo sapiens; identical to SEQ ID NO: 444

SEQ ID NO: 447 - DNA, 990 bp, Homo sapiens
tggtccccgccaccccccacccccactttgcagataaaccacatgcaggaaggtcagcctggcaagtccagtaagttcaagcccaggtctcaactgggcagcagagctcctgctcttctttgtcctcatatacgagcacctctggacttaaaacttgaggaactggatggagaaaagttaatggtcagcagcgggttacatcttctttcatgcgcctttccattctttggatcagtagtcactaacgttcgccagccataagtcctcgacgtggagaggctcagagcctggcatgaacatgaccctgaattcggatgcagagcttcttcccatgatgatctgtccctcacagcagggtcttctctgtttcagggcatgaactacttggaggaccgtcgcttggtgcaccgcgacctggcagccaggaacgtactggtgaaaacaccgcagcatgtcaagatcacagattttgggccggccaaactgctgggtgcggaagagaaagaataccatgcagaaggaggcaaagtaaggaggtggctttaggtcagccagcattttcctgacaccagggaccaggctgccttcccactagctgtattgtttaacacatgcaggggaggatgctctccagacattctgggtgagctcgcagcagctgctgctggcagctgggtccagccagggtctcctggtagtgtgagccagagctgctttgggaacagtacttgctgggacagtgaatgaggatgttatccccaggtgatcattagcaaatgttaggtttcagtctctccctgcaggatatataagtccccttcaatagcgcaattgggaaaggtcacagctgccttggtggtccactgctgtcaaggacacctaaggaacaggaaaggccccatgcggacccgagctcccagggctgtctgtggctcgtggctgggacaggcagcaatggagtccttctctcccttcactggctcggtttct

SEQ ID NO: 448 - RNA, 41 nt, Homo sapiens
uaauuucuacuaaguguagauggcuggccaaacugcugggu

SEQ ID NO: 449 - RNA, 41 nt, Homo sapiens
uaauuucuacuaaguguagauggcgggccaaacugcugggu

SEQ ID NO: 450 - DNA, 19 bp, Artificial Sequence
  source: /note="Description of Artificial Sequence: Synthetic primer"
ggcagccaggaacgtactg

SEQ ID NO: 451 - DNA, 27 bp, Artificial Sequence
  source: /note="Description of Artificial Sequence: Synthetic primer"
ccttctgcatggtattctttctcttcc

SEQ ID NO: 452 - DNA, 368 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaatcatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 453 - DNA, 371 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaagcaacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 454 - DNA, 362 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggatccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 455 - DNA, 365 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaaacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 456 - DNA, 365 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaagacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 457 - DNA, 362 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaaccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 458 - DNA, 362 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 459 - DNA, 365 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 460 - DNA, 362 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaatcgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 461 - DNA, 371 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaaccaacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 462 - DNA, 368 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaaccatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 463 - DNA, 362 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggttccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 464 - DNA, 362 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaaattccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 465 - DNA, 365 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggtatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 466 - DNA, 362 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaacagaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 467 - DNA, 365 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaacaaccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 468 - DNA, 368 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggttgcttctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 469 - DNA, 368 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggagcaatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 470 - DNA, 371 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggagccaacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 471 - DNA, 365 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggcatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 472 - DNA, 362 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaagtctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 473 - DNA, 371 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaaattccaacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 474 - DNA, 365 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaaatatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 475 - DNA, 368 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaaattccatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 476 - DNA, 362 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggtctcgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 477 - DNA, 365 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcgcaacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 478 - DNA, 356 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaattaagagaagcaaccctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 479 - DNA, 380 bp, Artificial Sequence
  source: /note="Description of Artificial Sequence: Synthetic polynucleotide"
gaagtgccattccgcctgacctagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaattaagagaagcaacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactaggctaggtggaggctcagtg

SEQ ID NO: 480 - RNA, 41 nt, Artificial Sequence
  source: /note="Description of Artificial Sequence: Synthetic oligonucleotide"
uaauuucuacuaaguguagauggagauguugcuucucuuaa

SEQ ID NO: 481 - RNA, 41 nt, Artificial Sequence
  source: /note="Description of Artificial Sequence: Synthetic oligonucleotide"
uaauuucuacuaaguguagauggagaugauuccuugauagc

SEQ ID NO: 482 - RNA, 41 nt, Artificial Sequence
  source: /note="Description of Artificial Sequence: Synthetic oligonucleotide"
uaauuucuacuaaguguagauggagauguugcuuccuugau

SEQ ID NO: 483 - RNA, 41 nt, Artificial Sequence
  source: /note="Description of Artificial Sequence: Synthetic oligonucleotide"
uaauuucuacuaaguguagauggauccuugauagcgacggg

SEQ ID NO: 484 - RNA, 41 nt, Artificial Sequence
  source: /note="Description of Artificial Sequence: Synthetic oligonucleotide"
uaauuucuacuaaguguagauggagauguuuugauagcgac

SEQ ID NO: 485 - RNA, 41 nt, Artificial Sequence
  source: /note="Description of Artificial Sequence: Synthetic oligonucleotide"
uaauuucuacuaaguguagauggagaugucuugauagcgac

SEQ ID NO: 486 - RNA, 41 nt, Artificial Sequence
  source: /note="Description of Artificial Sequence: Synthetic oligonucleotide"
uaauuucuacuaaguguagaugguuccuugauagcgacggg

SEQ ID NO: 487 - RNA, 41 nt, Artificial Sequence
  source: /note="Description of Artificial Sequence: Synthetic oligonucleotide"
uaauuucuacuaaguguagauggagccuugauagcgacggg

SEQ ID NO: 488 - RNA, 41 nt, Artificial Sequence
  source: /note="Description of Artificial Sequence: Synthetic oligonucleotide"
uaauuucuacuaaguguagauggagauuccuugauagcgac

SEQ ID NO: 489 - RNA, 41 nt, Artificial Sequence
  source: /note="Description of Artificial Sequence: Synthetic oligonucleotide"
uaauuucuacuaaguguagaugauuccuugauagcgacggg

SEQ ID NO: 490 - RNA, 41 nt, Artificial Sequence
  source: /note="Description of Artificial Sequence: Synthetic oligonucleotide"
uaauuucuacuaaguguagauggagauguugguuccuugau

SEQ ID NO: 491 - RNA, 41 nt, Artificial Sequence
  source: /note="Description of Artificial Sequence: Synthetic oligonucleotide"
uaauuucuacuaaguguagauggagaugguuccuugauagc

SEQ ID NO: 492 - RNA, 41 nt, Artificial Sequence
  source: /note="Description of Artificial Sequence: Synthetic oligonucleotide"
uaauuucuacuaaguguagauggaaccuugauagcgacggg

SEQ ID NO: 493 - RNA, 41 nt, Artificial Sequence
  source: /note="Description of Artificial Sequence: Synthetic oligonucleotide"
uaauuucuacuaaguguagauggaauuuugauagcgacggg

SEQ ID NO: 494 - RNA, 41 nt, Artificial Sequence
  source: /note="Description of Artificial Sequence: Synthetic oligonucleotide"
uaauuucuacuaaguguagauggagauaccuugauagcgac

SEQ ID NO: 495 - RNA, 41 nt, Artificial Sequence
  source: /note="Description of Artificial Sequence: Synthetic oligonucleotide"
uaauuucuacuaaguguagauuguuccuugauagcgacggg

SEQ ID NO: 496 - RNA, 41 nt, Artificial Sequence
  source: /note="Description of Artificial Sequence: Synthetic oligonucleotide"
uaauuucuacuaaguguagaugguuguuccuugauagcgac

SEQ ID NO: 497 - RNA, 41 nt, Artificial Sequence
  source: /note="Description of Artificial Sequence: Synthetic oligonucleotide"
uaauuucuacuaaguguagauggagaagcaaccuugauagc

SEQ ID NO: 498 - RNA, 41 nt, Artificial Sequence
  source: /note="Description of Artificial Sequence: Synthetic oligonucleotide"
uaauuucuacuaaguguagauggagauugcuccuugauagc

SEQ ID NO: 499 - RNA, 41 nt, Artificial Sequence
  source: /note="Description of Artificial Sequence: Synthetic oligonucleotide"
uaauuucuacuaaguguagauggagauguuggcuccuugau

SEQ ID NO: 500 - RNA, 41 nt, Artificial Sequence
  source: /note="Description of Artificial Sequence: Synthetic oligonucleotide"
uaauuucuacuaaguguagauggagaugccuugauagcgac

SEQ ID NO: 501 - RNA, 41 nt, Artificial Sequence
  source: /note="Description of Artificial Sequence: Synthetic oligonucleotide"
uaauuucuacuaaguguagauggagacuugauagcgacggg

SEQ ID NO: 502 - RNA, 41 nt, Artificial Sequence
  source: /note="Description of Artificial Sequence: Synthetic oligonucleotide"
uaauuucuacuaaguguagauggagauguuggaauuuugau

SEQ ID NO: 503 - RNA, 41 nt, Artificial Sequence
  source: /note="Description of Artificial Sequence: Synthetic oligonucleotide"
uaauuucuacuaaguguagauggagauauuuugauagcgac

SEQ ID NO: 504 - RNA, 41 nt, Artificial Sequence
  source: /note="Description of Artificial Sequence: Synthetic oligonucleotide"
uaauuucuacuaaguguagauggagauggaauuuugauagc

SEQ ID NO: 505 - RNA, 41 nt, Artificial Sequence
  source: /note="Description of Artificial Sequence: Synthetic oligonucleotide"
uaauuucuacuaaguguagaugagaccuugauagcgacggg

SEQ ID NO: 506 - RNA, 41 nt, Artificial Sequence
  source: /note="Description of Artificial Sequence: Synthetic oligonucleotide"
uaauuucuacuaaguguagauggagauguugcgauagcgac

SEQ ID NO: 507 - RNA, 51 nt, Artificial Sequence
  source: /note="Description of Artificial Sequence: Synthetic oligonucleotide"
ggccaccccaaaaaugaaggggacuaaaacaagcgaggacugcagcguaga

SEQ ID NO: 508 - RNA, 30 nt, Artificial Sequence
  source: /note="Description of Artificial Sequence: Synthetic oligonucleotide"
gucuaaaccucaaugaaaauuucuacuguu

SEQ ID NO: 509 - RNA, 25 nt, Artificial Sequence
  source: /note="Description of Artificial Sequence: Synthetic oligonucleotide"
ccuaauaauuucuacuguuguagau

SEQ ID NO: 510 - RNA, 36 nt, Artificial Sequence
  source: /note="Description of Artificial Sequence: Synthetic oligonucleotide"
cucgaauaccuauauuaaauuucuacuuuuguagau

SEQ ID NO: 511 - RNA, 36 nt, Artificial Sequence
  source: /note="Description of Artificial Sequence: Synthetic oligonucleotide"
guuuaauaaacacuuauaauuucuacuguuguagau

SEQ ID NO: 512 - RNA, 36 nt, Artificial Sequence
  source: /note="Description of Artificial Sequence: Synthetic oligonucleotide"
guuugguaccuuuauuaauuucuacuaaguguagau

SEQ ID NO: 513 - RNA, 36 nt, Artificial Sequence
  source: /note="Description of Artificial Sequence: Synthetic oligonucleotide"
guugaguaaccauaagaaaauuucuacuguguagau

SEQ ID NO: 514 - RNA, 36 nt, Artificial Sequence
  source: /note="Description of Artificial Sequence: Synthetic oligonucleotide"
guuuaauaaguaauaaaugucuacuguaguguagau

SEQ ID NO: 515 - RNA, 37 nt, Artificial Sequence
  source: /note="Description of Artificial Sequence: Synthetic oligonucleotide"
aguuaaauaauaagaaagaauuucuacuaguguagau

SEQ ID NO: 516 - RNA, 36 nt, Artificial Sequence
  source: /note="Description of Artificial Sequence: Synthetic oligonucleotide"
guuaaguaauauaaaagaauuucuacuauuguagau

SEQ ID NO: 517 - RNA, 36 nt, Artificial Sequence
  source: /note="Description of Artificial Sequence: Synthetic oligonucleotide"
guuugaccuacuaauuaaauuucuacuguuguagau

SEQ ID NO: 518 - RNA, 36 nt, Artificial Sequence
  source: /note="Description of Artificial Sequence: Synthetic oligonucleotide"
ggcuaaaaguaauaaacaauuucuacuuucguagau

SEQ ID NO: 519 - RNA, 36 nt, Artificial Sequence
  source: /note="Description of Artificial Sequence: Synthetic oligonucleotide"
gucaaauaguaacuaacaauuucuacuucgguagau

SEQ ID NO: 520 - RNA, 35 nt, Artificial Sequence
  source: /note="Description of Artificial Sequence: Synthetic oligonucleotide"
aucuacacaaaguagagauucgaaugaguuuugac

SEQ ID NO: 521 - RNA, 36 nt, Artificial Sequence
  source: /note="Description of Artificial Sequence: Synthetic oligonucleotide"
guuucaaagauuaaauaauuucuacuaaguguagau

SEQ ID NO: 522 - RNA, 36 nt, Artificial Sequence
  source: /note="Description of Artificial Sequence: Synthetic oligonucleotide"
gucuaagaacuuuaaauaauuucuacuguuguagau

SEQ ID NO: 523 - RNA, 36 nt, Artificial Sequence
  source: /note="Description of Artificial Sequence: Synthetic oligonucleotide"
auuugaaagcaucuuuuaauuucuacuauuguagau

SEQ ID NO: 524 - RNA, 36 nt, Artificial Sequence
  source: /note="Description of Artificial Sequence: Synthetic oligonucleotide"
cucuaauaagagauaugaauuucuacuguuguagau

SEQ ID NO: 525 - RNA, 36 nt, Artificial Sequence
  source: /note="Description of Artificial Sequence: Synthetic oligonucleotide"
cucuacaacugauaaagaauuucuacuuuuguagau

SEQ ID NO: 526 - RNA, 36 nt, Artificial Sequence
  source: /note="Description of Artificial Sequence: Synthetic oligonucleotide"
cucuagcaggccuggcaaauuucuacuguuguagau

SEQ ID NO: 527 - RNA, 36 nt, Artificial Sequence
  source: /note="Description of Artificial Sequence: Synthetic oligonucleotide"
gccaaauaccucuauaaaauuucuacuuuuguagau

SEQ ID NO: 528 - RNA, 36 nt, Artificial Sequence
  source: /note="Description of Artificial Sequence: Synthetic oligonucleotide"
gccaagaaccuauagauaauuucuacuguuguagau

SEQ ID NO: 529 - RNA, 36 nt, Artificial Sequence
  source: /note="Description of Artificial Sequence: Synthetic oligonucleotide"
ggcuauaaagcuuauuuaauuucuacuauuguagau

SEQ ID NO: 530 - RNA, 35 nt, Artificial Sequence
  source: /note="Description of Artificial Sequence: Synthetic oligonucleotide"
gucaaaagaccuuuuuaauuucuacucuuguagau

SEQ ID NO: 531 - RNA, 36 nt, Artificial Sequence
  source: /note="Description of Artificial Sequence: Synthetic oligonucleotide"
gucuaaaacucauucagaauuucuacuaguguagau

SEQ ID NO: 532 - RNA, 35 nt, Artificial Sequence
  source: /note="Description of Artificial Sequence: Synthetic oligonucleotide"
gucuaacuaccuuuuaauuucuacuguuuguagau

SEQ ID NO: 533 - RNA, 36 nt, Artificial Sequence
  source: /note="Description of Artificial Sequence: Synthetic oligonucleotide"
gucuauaagacauuuauaauuucuacuauuguagau

SEQ ID NO: 534 - RNA, 36 nt, Artificial Sequence
  source: /note="Description of Artificial Sequence: Synthetic oligonucleotide"
guuuaaaaccacuuuaaaauuucuacuauuguagau

SEQ ID NO: 535 - RNA, 36 nt, Artificial Sequence
  source: /note="Description of Artificial Sequence: Synthetic oligonucleotide"
guuuaaaaguccuauuggauuucuacuuuuguagau

SEQ ID NO: 536 - RNA, 37 nt, Artificial Sequence
  source: /note="Description of Artificial Sequence: Synthetic oligonucleotide"
ugcuuagaacauuuaaagaauuucuacuauuguagau

SEQ ID NO: 537 - RNA, 37 nt, Artificial Sequence
  source: /note="Description of Artificial Sequence: Synthetic oligonucleotide"
ugcuuaguacuuauaaagaauuucuacuauuguagau

SEQ ID NO: 538 - RNA, 27 nt, Artificial Sequence
  source: /note="Description of Artificial Sequence: Synthetic oligonucleotide"
guuaaguuauauagaauaauuucuacu

SEQ ID NO: 539 - RNA, 24 nt, Artificial Sequence
  source: /note="Description of Artificial Sequence: Synthetic oligonucleotide"
uccugcagcagaaaaucaaagaca

SEQ ID NO: 540 - RNA, 54 nt, Artificial Sequence
  source: /note="Description of Artificial Sequence: Synthetic oligonucleotide"
gucuaaaccucaaugaaaauuucuacuguuuccugcagcagaaaaucaaagaca

SEQ ID NO: 541 - RNA, 49 nt, Artificial Sequence
  source: /note="Description of Artificial Sequence: Synthetic oligonucleotide"
ccuaauaauuucuacuguuguagauuccugcagcagaaaaucaaagaca

SEQ ID NO: 542 - RNA, 60 nt, Artificial Sequence
  source: /note="Description of Artificial Sequence: Synthetic oligonucleotide"
cucgaauaccuauauuaaauuucuacuuuuguagauuccugcagcagaaaaucaaagaca

SEQ ID NO: 543 - RNA, 60 nt, Artificial Sequence
  source: /note="Description of Artificial Sequence: Synthetic oligonucleotide"
guuuaauaaacacuuauaauuucuacuguuguagauuccugcagcagaaaaucaaagaca

SEQ ID NO: 544 - RNA, 60 nt, Artificial Sequence
  source: /note="Description of Artificial Sequence: Synthetic oligonucleotide"
guuugguaccuuuauuaauuucuacuaaguguagauuccugcagcagaaaaucaaagaca

SEQ ID NO: 545 - RNA, 60 nt, Artificial Sequence
  source: /note="Description of Artificial Sequence: Synthetic oligonucleotide"
guugaguaaccauaagaaaauuucuacuguguagauuccugcagcagaaaaucaaagaca

SEQ ID NO: 546 - RNA, 60 nt, Artificial Sequence
  source: /note="Description of Artificial Sequence: Synthetic oligonucleotide"
guuuaauaaguaauaaaugucuacuguaguguagauuccugcagcagaaaaucaaagaca

SEQ ID NO: 547 - RNA, 61 nt, Artificial Sequence
  source: /note="Description of Artificial Sequence: Synthetic oligonucleotide"
aguuaaauaauaagaaagaauuucuacuaguguagauuccugcagcagaaaaucaaagaca

SEQ ID NO: 548 - RNA, 60 nt, Artificial Sequence
  source: /note="Description of Artificial Sequence: Synthetic oligonucleotide"
guuaaguaauauaaaagaauuucuacuauuguagauuccugcagcagaaaaucaaagaca

SEQ ID NO: 549 - RNA, 60 nt, Artificial Sequence
  source: /note="Description of Artificial Sequence: Synthetic oligonucleotide"
guuugaccuacuaauuaaauuucuacuguuguagauuccugcagcagaaaaucaaagaca

SEQ ID NO: 550 - RNA, 60 nt, Artificial Sequence
  source: /note="Description of Artificial Sequence: Synthetic oligonucleotide"
ggcuaaaaguaauaaacaauuucuacuuucguagauuccugcagcagaaaaucaaagaca

SEQ ID NO: 551 - RNA, 60 nt, Artificial Sequence
  source: /note="Description of Artificial Sequence: Synthetic oligonucleotide"
gucaaauaguaacuaacaauuucuacuucgguagauuccugcagcagaaaaucaaagaca

SEQ ID NO: 552 - RNA, 59 nt, Artificial Sequence
  source: /note="Description of Artificial Sequence: Synthetic oligonucleotide"
aucuacacaaaguagagauucgaaugaguuuugacuccugcagcagaaaaucaaagaca

SEQ ID NO: 553 - RNA, 60 nt, Artificial Sequence
  source: /note="Description of Artificial Sequence: Synthetic oligonucleotide"
guuucaaagauuaaauaauuucuacuaaguguagauuccugcagcagaaaaucaaagaca

SEQ ID NO: 554 - RNA, 60 nt, Artificial Sequence
  source: /note="Description of Artificial Sequence: Synthetic oligonucleotide"
gucuaagaacuuuaaauaauuucuacuguuguagauuccugcagcagaaaaucaaagaca

SEQ ID NO: 555 - RNA, 60 nt, Artificial Sequence
  source: /note="Description of Artificial Sequence: Synthetic oligonucleotide"
auuugaaagcaucuuuuaauuucuacuauuguagauuccugcagcagaaaaucaaagaca

SEQ ID NO: 556 - RNA, 60 nt, Artificial Sequence
  source: /note="Description of Artificial Sequence: Synthetic oligonucleotide"
cucuaauaagagauaugaauuucuacuguuguagauuccugcagcagaaaaucaaagaca

SEQ ID NO: 557 - RNA, 60 nt, Artificial Sequence
  source: /note="Description of Artificial Sequence: Synthetic oligonucleotide"
cucuacaacugauaaagaauuucuacuuuuguagauuccugcagcagaaaaucaaagaca

SEQ ID NO: 558 - RNA, 60 nt, Artificial Sequence
  source: /note="Description of Artificial Sequence: Synthetic oligonucleotide"
cucuagcaggccuggcaaauuucuacuguuguagauuccugcagcagaaaaucaaagaca

SEQ ID NO: 559 - RNA, 60 nt, Artificial Sequence
  source: /note="Description of Artificial Sequence: Synthetic oligonucleotide"
gccaaauaccucuauaaaauuucuacuuuuguagauuccugcagcagaaaaucaaagaca

SEQ ID NO: 560 - RNA, 60 nt, Artificial Sequence
  source: /note="Description of Artificial Sequence: Synthetic oligonucleotide"
gccaagaaccuauagauaauuucuacuguuguagauuccugcagcagaaaaucaaagaca

SEQ ID NO: 561 - RNA, 60 nt, Artificial Sequence
  source: /note="Description of Artificial Sequence: Synthetic oligonucleotide"
ggcuauaaagcuuauuuaauuucuacuauuguagauuccugcagcagaaaaucaaagaca

SEQ ID NO: 562 - RNA, 59 nt, Artificial Sequence
  source: /note="Description of Artificial Sequence: Synthetic oligonucleotide"
gucaaaagaccuuuuuaauuucuacucuuguagauuccugcagcagaaaaucaaagaca

SEQ ID NO: 563 - RNA, 60 nt, Artificial Sequence
  source: /note="Description of Artificial Sequence: Synthetic oligonucleotide"
gucuaaaacucauucagaauuucuacuaguguagauuccugcagcagaaaaucaaagaca

SEQ ID NO: 564 - RNA, 59 nt, Artificial Sequence
  source: /note="Description of Artificial Sequence: Synthetic oligonucleotide"
gucuaacuaccuuuuaauuucuacuguuuguagauuccugcagcagaaaaucaaagaca

SEQ ID NO: 565 - RNA, 60 nt, Artificial Sequence
  source: /note="Description of Artificial Sequence: Synthetic oligonucleotide"
gucuauaagacauuuauaauuucuacuauuguagauuccugcagcagaaaaucaaagaca

SEQ ID NO: 566 - RNA, 60 nt, Artificial Sequence
  source: /note="Description of Artificial Sequence: Synthetic oligonucleotide"
guuuaaaaccacuuuaaaauuucuacuauuguagauuccugcagcagaaaaucaaagaca

SEQ ID NO: 567 - RNA, 60 nt, Artificial Sequence
  source: /note="Description of Artificial Sequence: Synthetic oligonucleotide"
guuuaaaaguccuauuggauuucuacuuuuguagauuccugcagcagaaaaucaaagaca

SEQ ID NO: 568 - RNA, 61 nt, Artificial Sequence
  source: /note="Description of Artificial Sequence: Synthetic oligonucleotide"
ugcuuagaacauuuaaagaauuucuacuauuguagauuccugcagcagaaaaucaaagaca

SEQ ID NO: 569 - RNA, 61 nt, Artificial Sequence
  source: /note="Description of Artificial Sequence: Synthetic oligonucleotide"
ugcuuaguacuuauaaagaauuucuacuauuguagauuccugcagcagaaaaucaaagaca

SEQ ID NO: 570 - RNA, 51 nt, Artificial Sequence
  source: /note="Description of Artificial Sequence: Synthetic oligonucleotide"
guuaaguuauauagaauaauuucuacuuccugcagcagaaaaucaaagaca

SEQ ID NO: 571 - protein, 1297 aa, Unknown
  source: /note="Description of Unknown: Cas12 variant sequence"
MATLVSFTKQYQVQKTLRFELIPQGKTQANIDAKGFINDDLKRDENYMKVKGVIDELHKNFIEQTLVNVDYDWRSLATAIKNYRKDRSDTNKKNLEKTQEAARKEIIAWFEGKRGNSAFKNNQKSFYGKLFKKELFSEILRSDDLEYDEETQDAIACFDKFTTYFVGFHENRKNMYSTEAKSTSVAYRVVNENFSKFLSNCEAFSVLEAVCPNVLVEAEQELHLHKAFSDLKLSDVFKVEAYNKYLSQTGIDYYNQIIGGISSAEGVRKIRGVNEVVNNAIQQNDELKVALRNKQFTMVQLFKQILSDRSTLSFVSEQFTSDQEVITVVKQFNDDIVNNKVLAVVKTLFENFNSYDLEKIYINSKELASVSNALLKDWSKIRNAVLENKIIELGANPPKTKISAVEKEVKNKDFSIAELASYNDKYLDKEGNDKEICSIANVVLEAVGALEIMLAESLPADLKTLENKNKVKGILDAYENLLHLLNYFKVSAVNDVDLAFYGAFEKVYVDISGVMPLYNKVRNYATKKPYSVEKFKLNFAMPTLADGWDKNKERDNGSIILLKDGQYYLGVMNPQNKPVIDNAVCNDAKGYQKMVYKMFPEISKMVTKCSTQLNAVKAHFEDNTNDFVLDDTDKFISDLTITKEIYDLNNVLYDGKKKFQIDYLRNTGDFAGYHKALETWIDFVKEFLSKYRSTAIYDLTTLLPTNYYEKLDVFYSDVNNLCYKIDYENISVEQVNEWVEEGNLYLFKIYNKDFATGSTGKPNLHTMYWNAVFAEENLHDVVVKLNGGAELFYRPKSNMPKVEHRVGEKLVNRKNVNGEPIADSVHKEIYAYANGKISKSELSENAQEELPLAIIKDVKHNITKDKRYLSDKYFFHVPITLNYKANGNPSAFNTKVQAFLKNNPDVNIIGIDRGERNLLYVVVIDQQGNIIDKKQVSYNKVNGYDYYEKLNQREKERIEARQSWGAVGKIKELKEGYLSLVVREIADMMVKYNAIVVMENLNAGFKRVRGGIAEKAVYQKFEKMLIDKLNYLVFKDVEAKEAGGVLNAYQLTDKFDSFEKMGNQSGFLFYVPAAYTSKIDPVTGFANVFSTKHITNTEAKKEFICSFNSLRYDEAKDKFVLECDLNKFKIVANSHIKNWKFIIGGKRIVYNSKNKTYMEKYPCEDLKATLNASGIDFSSSEIINLLKNVPANREYGKLFDETYWAIMNTLQMRNSNALTGEDYIISAVADDNEKVFDSRTCGAELPKDADANGAYHIALKGLYLLQRIDISEEGEKVDLSIKNEEWFKFVQQKEYAR

SEQ ID NO: 572 - protein, 1229 aa, Unknown
  source: /note="Description of Unknown: Cas12 variant sequence"
MKEQFINRYPLSKTLRFSLIPVGETENNFNKNLLLKKDKQRAENYEKVKCYIDRFHKEYIESVLSKARIEKVNEYANLYWKSNKDDSDIKAMESLENDMRKQISKQLTSTEIYKKRLFGKELICEDLPSFLTDKDERETVECFRSFTTYFKGFNTNRENMYSSDGKSTAIAYRCINDNLPRFLDNVKSFQKVFDNLSDETITKLNTDLYNIFGRNIEDIFSVDYFEFVLTQSGIEIYNSMIGGYTCSDKTKIQGLNECINLYNQQVAKNEKSKKLPLMKPLYKQILSEKDSVSFIPEKFNSDNEVLHAIDDYYTGHIGDFDLLTELLQSLNTYNANGIFVKSGVAITDISNGAFNSWNVLRSAWNEKYEALHPVTSKTKIDKYIEKQDKIYKAIKSFSLFELQSLGNENGNEITDWYISSINESNSKIKEAYLQAQKLLNSDYEKSYNKRLYKNEKATELVKNLLDAIKEFQKLIKPLNGTGKEENKDELFYGKFTSYYDSIADIDRLYDKVRNYITQKPYSKDKIKLNFDNPQLLGGWDKNKESDYRTVLLHKDGLYYLAVMDKSHSKAFVDAPEITSDDKDYYEKMEYKLLPGPNKMLPKVFFASKNIDTFQPSDRILDIRKRESFKKGATFNKAECHEFIDYFKDSIKKHDDWSQFGFKFSPTESYNDISEFYREISDQGYSVRFNKISKNYIDGLVNNGYIYLFQIYNKDFSKYSKGTPNLHTLYFKMLFDERNLSNVVYKLNGEAEMFYREASIGDKEKITHYANQPIKNKNPDNEKKESVFEYDIVKDKRFTKRQFSLHLPITINFKAHGQEFLNYDVRKAVKYKDDNYVIGIDRGERNLIYISVINSNGEIVEQMSLNEIISDNGHKVDYQKLLDTKEKERDKARKNWTSVENIKELKEGYISQVVHKICELVIKYDAVIAMEDLNFGFKRGRFPVEKQVYQKFENMLISKLNLLIDKKAEPTEDGGLLRAYQLTNKFDGVNKAKQNGIIFYVPAWDTSKIDPATGFVNLLKPKCNTSVPEAKKLFETIDDIKYNANTDMFEFYIDYSKFPRCNSDFKKSWTVCTNSSRILTFRNKEKNNKWDNKQIVLTDEFKSLFNEFGIDYKGNLKDSILSISNADFYRRLIKLLSLTLQMRNSITGSTLPEDDYLISPVANKSGEFYDSRNYKGTNAALPCDADANGAYNIARKALWAINVLKDTPDDMLNKAKLSITNAEWLEYTQK

SEQ ID NO: 573 - protein, 1470 aa, Unknown
  source: /note="Description of Unknown: Cas12 variant sequence"
MNNPRGAFGGFTNLYSLSKTLRFELKPYLEIPEGEKGKLFGDDKEYYKNCKTYTEYYLKKANKEYYDNEKVKNTDLQLVNFLHDERIEDAYQVLKPVFDTLHEEFITDSLESAEAKKIDFGNYYGLYEKQKSEQNKDEKKKIDKPLETERGKLRKAFTPIYEAEGKNLKNKAGKEKKDKDILKESGFKVLIEAGILKYIKNNIDEFADKKLKNNEGKEITKKDIETALGAENIEGIFDGFFTYFSGFNQNRENYYSTEEKATAVASRIVDENLSKFCDNILLYRKNENDYLKIFNFLKNKGKDLKLKNSKFGKENEPEFIPAYDMKNDEKSFSVADFVNCLSQGEIEKYNAKIANANYLINLYNQNKDGNSSKLSMFKILYKQIGCGEKKDFIKTIKDNAELKQILEKACEAGKKYFIRGKSEDGGVSNIFDFTDYIQSHENYKGVYWSDKAINTISGKYFANWDTLKNKLGDAKVFNKNTGEDKADVKYKVPQAVMLSELFAVLDDNAGEDWREKGIFFKASLFEGDQNKSEIIKNANRPSQALLKMICDDMESLAKNFIDSGDKILKISDRDYQKDENKQKIKNWLDNALWINQILKYFKVKANKIKGDSIDARIDSGLDMLVFSSDNPAEDYDMIRNYLTQKPQDEINKLKLNFENSSLAGGWDENKEKDNSCIILKDEQDKQYLAVMKYENTKVFEQKNSQLYIADNAAWKKMIYKLVPGASKTLPKVFFSKKWTANRPTPSDIVEIYQKGSFKKENVDFNDKKEKDESRKEKNREKIIAELQKTCWMDIRYNIDGKIESAKYVNKEKLAKLIDFYKENLKKYPSEEESWDRLFAFGFSDTKSYKSIDQFYIEVDKQGYKLEFVTINKARLDEYVRDGKIYLFEIRSRDNNLVNGEEKTSAKNLQTIYWNAAFGGDDNKPKLNGEAEIFYRPAIAENKLNKKKDKNGKEIIDGYRFSKEKFIFHCPITLNFCLKETKINDKLNAALAKPENGQGVYFLGIDRGEKHLAYYSLVNQKGEILEQGTLNLPFLDKNGKSRSIKVEKKSFEKDSNGGIIKDKDGNDKIKIEFVECWNYNDLLDARAGDRDYARKNWTTIGTIKELKDGYISQVVRKIVDLSIYKNTETKEFREMPAFIVLEDLNIGFKRGRQKIEKQVYQKLELALAKKLNFLVDKKADIGEIGSVTKAIQLTPPVNNFGDMENRKQFGNMLYIRADYTSQTDPATGWRKSIYLKSGSESNVKEQIEKSFFDIRYESGDYCFEYRDRHGKMWQLYSSKNGVSLDRFHGERNNSKNVWESEKQPLNEMLDILFDEKRFDKSKSLYEQMFKGGVALTRLPKEINKKDKPAWESLRFVIILIQQIRNTGKNGDDRNGDFIQSPVRDEKTGEHFDSRIYLDKEQKGEKADLPTSGDANGAYNIARKGIVVAEHIKRGFDKLYISDEEWDTWLAGDEIWDKWLKENRESLTKTRK

SEQ ID NO: 574 - protein, 1282 aa, Unknown
  source: /note="Description of Unknown: Cas12 variant sequence"
MNGNRIIVYREFVGVTPVAKTLRNELRPIGHTQEHIIHNGLIQEDELRQEKSTELKNIMDDYYREYIDKSLSGVTDLDFTLLFELMNLVQSSPSKDNKKALEKEQSKMREQICTHMQSDSNYKNIFNAKFLKEILPDFIKNYNQYDAKDKAGKLETLALFNGFSTYFTDFFEKRKNVFTKEAVSTSIAYRIVHENSLTFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDEHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYNDISEFYREVEMQGYRIDWTYISEADINKLDEEGKIYLFQIYNKDFAENSTGKENLHTMYFKNIFSEENLKDIIIKLNGQAELFYRRASVKNPVKHKKDSVLVNKTYKNQLDNGDVVRIPIPDDIYNEIYKMYNGYIKENDLSEAAKEYLDKVEVRTAQKDIVKDYRYTVDKYFIHTPITINYKVTARNNVNDMAVKYIAQNDDIHVIGIDRGERNLIYISVIDSHGNIVKQKSYNILNNYDYKKKLVEKEKTREYARKNWKSIGNIKELKEGYISGVVHEIAMLMVEYNAIIAMEDLNYGFKRGRFKVERQVYQKFESMLINKLNYFASKGKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMSKTQWTVYTNGERLQSEFNNARRTGKTKSINLTETIKLLLEDNEINYADGHDVRIDMEKMDEDKNSEFFAQLLSLYKLTVQMRNSYTEAEEQEKGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 575 - protein, 1225 aa, Unknown
  source: /note="Description of Unknown: Cas12 variant sequence"
MKKIDSFVNYYPLSKTLRFSLIPVGKTEDNFNAKLLLEEDEKRAIEYEKVKRYIDRYHKHFIETVLANFHLDDVNEYAELYYKAGKDDKDLKYMEKLEGKMRKSISAAFTKDKKYKEIFGQEIIKNILPEFLENEDEKESVKMFQGFFTYFTGFNDNRKNMYTHEAQTTAISYRCINENLPKFLDNVQSFAKIKESISSDIMNKLDEVCMDLYGVYAQDMFCTDYFSFVLSQSGIDRYNNIIGGYVDDKGVKIQGINEYINLYNQQVDEKNKRLPLMKKLYKQILIEKESISFIPEKFESDNIVINAISDYYHNNVENLFDDFNKLFNEFSEYDDNGIFVTSGLAVTDISNAVFGSWNIISDSWNEEYKDSHPMKKTTNAEKYYEDMKKEYKKNLSFTIAELQRLGEAGCNDECKGDIKEYYKTTVAEKIENIKNAYEISKDLLASDYEKSNDKKLCKNDSAISLLKNLLDSIKDLEKTIKPLLGTGKEENKDDVFYGKFTNLYEMISEIDRLYDKVRNYVTQKPYSKDKIKLNFENPQHLGGWDKNKERDYRSVLLKKEDKYYLAIMDKSNNKAFIDFPDDGECYEKIEYKLLPGPNKMLPKVFFASSNIEYFAPSKKILEIRSRESFKKGDMFNLKDCHEFIDFFKESIKKHEDWSQFGFEFSPTEKYNDISEFYNEVKIQGYSLKYKNVSKKYIDELIECGQLYLFQIYNKDFSVYAKGNPNLHTMYFKMLFDERNLANVVYQLNGGAEMFYRKASIKDSEKIVHHANQPIKNKNADNVKKESVFEYDIIKDKRFTKRQFSIHIPITLNFKAKGQNFINNDVRMALKKADENYVIGIDRGERNLLYICVINSKGEIVEQKSLNEIIGDNGYRVDYHKLLDKKEAERDEARKSWGTIENIKELKEGYLSQIVHEISKLVIKYDAVIAIEDLNSGFKKGRFKVEKQVYQKFENMLCTKLNYLVDKNADANECGGLLKAYQLTNKEDGANRGRQNGIIFSVPAWLTSKIDPVTGFADLLRPKYKSVSESVEFISKIDNIRYNSKEDYFEFDIDYSKFPNSTASYKKKWTVCTYGERIINVRNKEKNNMWDNKTIVLTDEFKKLFADFGVDVSKNIKESVLAIDSKDFYYRFINLLANTLQLRNSEVGNVDVDYLISPVKGVDGSFYDSRLVKEKTLPENADANGAYNIARKALWAIDVLKQTKDEELKNANLSIKNAEWLEYVQK

SEQ ID NO: 576 - protein, 1293 aa, Unknown
  source: /note="Description of Unknown: Cas12 variant sequence"
MRTMVTFEDFTKQYQVSKTLRFELIPQGKTLENMKRDGIISVDRQRNEDYQKAKGILDKLYKYILDFTMETVVIDWEALATATEEFRKSKDKKTYEKVQSKIRTALLEHVKKQKVGTEDLFKGMFSSKIITGEVLAAFPEIRLSDEENLILEKFKDFTTYFTGFFENRKNVFTDEALSTSFTYRLVNDNFIKFFDNCIVFKNVVNISPHMAKSLETCASDLGIFPGVSLEEVFSISFYNRLLTQTGIDQFNQLLGGISGKEGEHKQQGLNEIINLAMQQNLEVKEVLKNKAHRFTPLFKQILSDRSTMSFIPDAFADDDEVLSAVDAYRKYLSEKNIGDRAFQLISDMEAYSPELMRIGGKYVSVLSQLLFYSWSEIRDGVKAYKESLITGKKTKKELENIDKEIKYGVTLQEIKEALPKKDIYEEVKKYAMSVVKDYHAGLAEPLPEKIETDDERASIKHIMDSMLGLYRFLEYFSHDSIEDTDPVFGECLDTILDDMNETVPLYNKVRNFSTRKVYSTEKFKLNFNNSSLANGWDKNKEQANGAILLRKEGEYFLGIFNSKNKPKLVSDGGAGIGYEKMIYKQFPDFKKMLPKCTISLKDTKAHFQKSDEDFTLQTDKFEKSIVITKQIYDLGTQTVNGKKKFQVDYPRLTGDMEGYRAALKEWIDFGKEFIQAYTSTAIYDTSLFRDSSDYPDLPSFYKDVDNICYKLTFEWIPDAVIDDCIDDGSLYLFKLHNKDFSSGSIGKPNLHTLYWKALFEEENLSDVVVKLNGQAELFYRPKSLTRPVVHEEGEVIINKTTSTGLPVPDDVYVELSKFVRNGKKGNLTDKAKNWLDKVTVRKMPHAITKDRRFTVDKFFFHVPITLNYKADSSPYRFNDFVRQYIKDCSDVKIIGIDRGERNLIYAVVIDGKGNIIEQRSFNTVGTYNYQEKLEQKEKERQTARQDWATVTKIKDLKKGYLSAVVHELSKMIVKYKAIVALENLNVGFKRMRGGIAERSVYQQFEKALIDKLNYLVFKDEEQSGYGGVLNAYQLTDKFESFSKMGQQTGFLFYVPAAYTSKIDPLTGFINPFSWKHVKNREDRRNFLNLFSKLYYDVNTHDFVLAYHHSNKDSKYTIKGNWEIADWDILIQENKEVFGKTGTPYCVGKRIVYMDDSTTGHNRMCAYYPHTELKKLLSEYGIEYTSGQDLLKIIQEFDDDKLVKGLFYIIKAALQMRNSNSETGEDYISSPIEGRPGICFDSRAEADTLPYDADANGAFHIAMKGLLLTERIRNDDKLAISNEEWLNYIQEMRG

SEQ ID NO: 577 - protein, 1399 aa, Unknown
  source: /note="Description of Unknown: Cas12 variant sequence"
MNKDIRKNFTDFVGISEIQKTLRFILIPIGKTAQNIDKYNMFEDDEIRHEYYPILKEACDDFYRNHIDQQFENLELDWSKLDEALASEDRDLINETRATYRQVLFNRLKNSVDIKGDSKKNKTLSLESSDKNLGKKKTKNTFQYNFNDLFKAKLIKAILPLYIEYIYEGEKLENAKKALKMYNRFTSRLSNFWQARANIFTDDEISTGSPYRLVNDNFTIFRINNSIYTKNKPFIEEDILEFEKKLKSKKIIKDFESVDDYFTVNAFNKLCTQNGIDKYNSILGGFTTKEREKVKGLNELFNLAQQSINKGKKGEYRKNIRLGKLTKLKKQILAISDSTSFLIEQIEDDQDLYNKIKDFFELLLKEEIENENIFTQYANLQKLIEQADLSKIYINAKHLNKISHQVTGKWDSLNKGIALLLENININEESKEKSEVISNGQTKDISSEAYKRYLQIQSEEKDIERLRTQIYFSLEDLEKALDLVLIDENMDRSDKSILSYVQSPDLNVNFERDLTDLYSRIMKLEENNEKLLANHSAIDLIKEFLDLIMLRYSRWQILFCDSNYELDQTFYPIYDAVMEILSNIIRLYNLARNYLSRKPDRMKKKKINFNNPTLADGWSESKIPDNSSMLFIKDGMYYLGIIKNRAAYSELLEAESLQSSEKKKSENSSYERMNYHFLPDAFRSIPKSSIAMKAVKEHFEINQKTADLLLDTDKFSKPLRITKEIFDMQYVDLHKNKKKYQVDYLRDTGDKKGYRKALNTWLNFCKDFISKYKGRNLFDYSKIKDADHYETVNEFYNDVDKYSYHIFFTSVAETTVEKFISEGKLYLFQLYNKDFSPHSTGKPNLHTIYWRALFSEENLTSKNIKLNGQAEIFFRPKQIETPFTHKKGSILVNRFDVNGNPIPINVYQEIKGFKNNVIKWDDLNKTTQEGLENDQYLYFESEFEIIKDRRYTEDQLFFHVPISFNWDIGSNPKINDLATQYIVNSNDIHIIGIDRGENHLIYYSVIDLQGAIVEQGSLNTITEYTENKFLNNKTNNLRKIPYKDILQQREDERADARIKWHAIDKIKDLKDGYLGQIVHFLAKLIIKYNAIVILEDLNYGFKRGRFKVERQVYQKFEMALMKKLNVLVFKDYDIDEIGGPLKPWQLTRPIDSYERMGRQNGILFYVPAAYTSAVDPVTGFANLFYLNNVKNSEKFHFFSKFESIKYHSDQDMFSFAFDYNNFGTTTRINDLSKSKWQVFTNHERSVWNNKEKNYVTQNLTDLIKKLLRTYNIEFKNNQNVLDSILKIENNTDKENFARELFRLFRLTIQLRNTTVNENNTEITENELDYIISPVKDKNGNFFDSRDELKNLPDNGDANGAYNIARKGLLYIEQLQESIKTGKLPTLSISTLDWFNYIMK

SEQ ID NO: 578 - protein, 1272 aa, Unknown
  source: /note="Description of Unknown: Cas12 variant sequence"
MTPIFCNFVVYQIMLFNNNININVKTMNKKHLSDFTNLFPVSKTLRFRLEPQGKTMENIVKAQTIETDEERSHDYEKTKEYIDDYHRQFIDDTLDKFAFKVESTGNNDSLQDYLDAYLSANDNRTKQTEEIQTNLRKAIVSAFKMQPQFNLLFKKEMVKHLLPQFVDTDDKKRIVAKFNDFTTYFTGFFTNRENMYSDEAKSTSIAYRIVNQNLIKFVENMLTFKSHILPILPQEQLATLYDDFKEYLNVASIAEMFELDHFSIVLTQRQIEVYNSVIGGRKDENNKQIKPGLNQYINQHNQAVKDKSARLPLLKPLFNQILSEKAGVSFLPKQFKSASEVVKSLNEAYAELSPVLAAIQDVVTNITDYDCNGIFIKNDLGLTDIAQRFYGNYDAVKRGLRNQYELETPMHNGQKAEKYEEQVAKHLKSIESVSLAQINQVVTDGGDICDYFKAFGATDDGDIQRENLLASINNAHTAISPVLNKENANDNELRKNTMLIKDLLDAIKRLQWFAKPLLGAGDETNKDQVFYGKFEPLYNQLDETISPLYDKVRSYLTKKPYSLDKFKINFEKSNLLGGWDPGADRKYQYNAVILRKDNDFYLGIMRDEATSKRKCIQVLDCNDEGLDENFEKVEYKQIKPSQNMPRCAFAKKECEENADIMELKRKKNAKSYNTNKDDKNALIRHYQRYLDRTYPEFGFVYKDADEYDTVKAFTDSMDSQDYKLSFLQVSETGLNKLVDEGDLYLFKITNKDFSSYAKGRPNLHTIYWRMLFDPKNLANVVYKLEGKAEVFFRRKSLASTTTHKAKQAIKNKSRYNEAVKPQSTFDYDIIKDRRFTADKFEFHVPIKMNFKAAGWNSTRLTNEVREFIKSQGVRHIIGIDRGERHLLYLTMIDMDGNIVKQCSLNAPAQDNARASEVDYHQLLDSKEADRLAARRNWGTIENIKELKQGYLSQVVHLLATMMVDNDAILVLENLNAGFMRGRQKVEKSVYQKFEKMLIDKLNYIVDKGQSPDKPTGALHAVQLTGLYSDFNKSNMKRANVRQCGFVFYIPAWNTSKIDPVTGFVNLFDTHLSSMGEIKAFFSKFDSIRYNQDKGWFEFKFDYSRFTTRAEGCRTQWTVCTYGERIWTHRSKNQNNQFVNDTVNVTQQMLQLLQDCGIDPNGNLKEAIANIDSKKSLETLLHLFKLTVQMRNSVTGSEVDYMISPVADERGHFFDSRESDEHLPANADANGAFNIARKGLMVVRQIMATDDVSKIKFAVSNKDWLRFAQHIDD

SEQ ID NO: 579 - protein, 1313 aa, Unknown
  source: /note="Description of Unknown: Cas12 variant sequence"
MNKGGYVIMEKMTEKNRWENQFRITKTIKEEIIPTGYTKVNLQRVNMLKREMERNEDLKKMKEICDEYYRNMIDVSLRLEQVRTLGWESLIHKYRMLNKDEKEIKALEKEQEDLRKKISKGFGEKKAWTGEQFIKKILPQYLMDHYTGEELEEKLRIVKKFKGCTMFLSTFFKNRENIFTDKPIHTAVGHRITSENAMLFAANINTYEKMESNVTLEIERLQREFWRRGINISEIFTDAYYVNVLTQKQIEAYNKICGDINQHMNEYCQKQKLKFSEFRMRELKKQILAVVGEHFEIPEKIESTKEVYRELNEYYESLKELHGQFEELKSVQLKYSQIYVQKKGYDRISRYIGGQWDLIQECMKKDCASGMKGTKKNHDAKIEEEVAKVKYQSIEHIQKLVCTYEEDRGHKVTDYVDEFIVSVCDLLGADHIITRDGERIELPLQYEPGTDLLKNDTINQRRLSDIKTILDWHMDMLEWLKTFLVNDLVIKDEEFYMAIEELNERMQCVISVYNRIRNYVTQKGYEPEKIRICFDKGTILTGWTTGDNYQYSGFLLMRNDKYYLGIINTNEKSVRKILDGNEECKDENDYIRVGYHLINDASKQLPRIFVMPKAGKKSEILMKDEQCDYIWDGYCHNKHNESKEFMRELIDYYKRSIMNYDKWEGYCFKFSSTESYDNMQDFYKEVREQSYNISFSYINENVLEQLDKDGKIYLFQVYNKDFAAGSTGTPNLHTMYLQNLFSSQNLELKRLRLGGNAELFYRPGTEKDVTHRKGSILVDRTYVREEKDGIEVRDTVPEKEYLEIYRYLNGKQKGDLSESAKQWLDKVHYREAPCDIIKDKRYAQEKYFLHFSVEINPNAEGQTALNDNVRRWLSEEEDIHVIGIDRGERNLIYVSLMDGKGRIKDQKSYNIVNSGNKEPVDYLAKLKVREKERDEARRNWKAIGKIKDIKTGYLSYVVHEIVEMAVREKAIIVMEDLNYGFKRGRFKVERQVYQKFEEMLINKLNYVVDKQLSVDEPGGLLRGYQLAFIPKDKKSSMRQNGIVFYVPAGYTSKIDPTTGFVNIFKFPQFGKGDDDGNGKDYDKIRAFFGKFDEIRYECDEKVTADNTREVKERYRFDFDYSKFETHLVHMKKTKWTVYAEGERIKRKKVGNYWTSEVISDIALRMSNTLNIAGIEYKDGHNLVNEICALRGKQAGIILNELLEIVRLTVQLRNSTTEGDVDERDEIISPVLNEKYGCFYHSTEYKQQNGDVLPKDADANGAYCIGLKGIYEIRQIKNKWKEDMTKGEGKALNEGMRISHDQWFEFIQNMNKGE

SEQ ID NO: 580 - protein, 1134 aa, Unknown
  source: /note="Description of Unknown: Cas12 variant sequence"
MNELVKNRCKQTKTICQKLIPIGKTRETIEKYNLMEIDRKIAANKELMNKLFSLIAGKHINDTLSKCTDLDFEPLLTSLSSLNNAKENDRDNLREYYDSVFEEKKTLAEEISSRLTAVKFAGKDFFTKNIPDFLETYEGDDKNEMSELVSLVIENTVTAGYVKKLEKIDRSMEYRLVSGTVVKRVLTDNADIYEKNIEKAKDFDYGVLNIDEASQFTTLVAKDYANYLTADGIAIYNVGIGKINLALNEYCQKNKEYSYNKLALLPLQKMLYGEKLSLFEKLEDFTSDEELINSYNKFAKTVNESGLAEIIKKAVPSYDEIVIKPNKISNYSNSITGHWSLVNRIMKDYLENNGIKNADKYMEKGLTLSEIGDALENKNIKHSDFISNLINDLGHTYTEIKENKESLKKDESVNALIIKKELDMLLSILQNLKVFDIDNEMFDTGFGIEVSKAIEILGYGVPLYNKIRNYITKKPDPKKKFMTKFGSATIGTGITTSVEGSKKATFLKDGDAVFLLLYNTAGCKANNVSVSNLADLINSSLEIENSGKCYQKMIYQTPGDIKKQIPRVFVYKSEDDDLIKDFKAGLHKTDLSFLNGRLIPYLKEAFATHETYKNYTFSYRNSYESYDEFCEHMSEQAYILEWKWIDKKLIDDLVEDGSLLMFRVWNRFMKKKEGKISKHAKIVNELFSDENASNAAIKLLSVFDIFYRDKQIDNPIVHKAGTTLYNKRTKDGEVIVDYTTMVKNKEKRPNVYTTTKKYDIIKDRRYTEEQFEIHLHVNIGKEENKEKLETSKVINEKKNTLVVTRSNEHLLYVVIFDENDNILLKKSLNTVKGMNFKSKLEVVEIQKKENMQSWKTVGSNQALMEGYLSFAIKEIADLVKEYDAILVLEQNSVGKNILNERVYTRFKEMLITNLSLDVDYENKDFYSYTELGGKVASWRDCVTNGICIQVPSAYKYKDPTTSFSTISMYAKTTAEKSKKLKQIKSFKYNRERGLFELVIAKGVGLENNIVCDSFGSRSIIENDISKEVSCTLKIEKYLIDAGIEYNDEKEVLKDLDTAAKTDAVHKAVTLLLKCFNESPDGRYYISPCGEHFTLCDAPEVLSAINYYIRSRYIREQIVEGVKKMEYKKTILLAK

SEQ ID NO: 581 - protein, 1259 aa, Unknown
  source: /note="Description of Unknown: Cas12 variant sequence"
MNYKTGLEDFIGKESLSKTLRNALIPTESTKIHMEEMGVIRDDELRAEKQQELKEIMDDYYRTFIEEKLGQIQGIQWNSLFQKMEETMEDISVRKDLDKIQNEKRKEICCYFTSDKRFKDLFNAKLITDILPNFIKDNKEYTEEEKAEKEQTRVLFQRFATAFTNYFNQRRNNFSEDNISTAISFRIVNENSEIHLQNMRAFQRIEQQYPEEVCGMEEEYKDMLQEWQMKHIYSVDFYDRELTQPGIEYYNGICGKINEHMNQFCQKNRINKNDFRMKKLHKQILCKKSSYYEIPFRFESDQEVYDALNEFIKTMKKKEIIRRCVHLGQECDDYDLGKIYISSNKYEQISNALYGSWDTIRKCIKEEYMDALPGKGEKKEEKAEAAAKKEEYRSIADIDKIISLYGSEMDRTISAKKCITEICDMAGQISIDPLVCNSDIKLLQNKEKTTEIKTILDSFLHVYQWGQTFIVSDIIEKDSYFYSELEDVLEDFEGITTLYNHVRSYVTQKPYSTVKFKLHFGSPTLANGWSQSKEYDNNAILLMRDQKFYLGIFNVRNKPDKQIIKGHEKEEKGDYKKMIYNLLPGPSKMLPKVFITSRSGQETYKPSKHILDGYNEKRHIKSSPKFDLGYCWDLIDYYKECIHKHPDWKNYDFHFSDTKDYEDISGFYREVEMQGYQIKWTYISADEIQKLDEKGQIFLFQIYNKDFSVHSTGKDNLHTMYLKNLFSEENLKDIVLKLNGEAELFFRKASIKTPIVHKKGSVLVNRSYTQTVGNKEIRVSIPEEYYTEIYNYLNHIGKGKLSSEAQRYLDEGKIKSFTATKDIVKNYRYCCDHYFLHLPITINFKAKSDVAVNERTLAYIAKKEDIHIIGIDRGERNLLYISVVDVHGNIREQRSFNIVNGYDYQQKLKDREKSRDAARKNWEEIEKIKELKEGYLSMVIHYIAQLVVKYNAVVAMEDLNYGFKTGRFKVERQVYQKFETMLIEKLHYLVFKDREVCEEGGVLRGYQLTYIPESLKKVGKQCGFIFYVPAGYTSKIDPTTGFVNLFSFKNLTNRESRQDFVGKFDEIRYDRDKKMFEFSFDYNNYIKKGTILASTKWKVYTNGTRLKKIVVNGKYTSQSMEVELTDAMEKMLQRAGIEYHDGKDLKGQIVEKGIEAEIIDIFRLTVQMRNSRSESEDREYDRLISPVLNDKGEFFDTATADKTLPQDADANGAYCIALKGLYEVKQIKENWKENEQFPRNKLVQDNKTWFDFMQKKRYL

SEQ ID NO: 582 - protein, 1271 aa, Unknown
  source: /note="Description of Unknown: Cas12 variant sequence"
MEDKQFLERYKEFIGLNSLSKTLRNSLIPVGSTLKHIQEYGILEEDSLRAQKREELKGIMDDYYRNYIEMHLRDVHDIDWNELFEALTEVKKNQTDDAKKRLEKIQEKKRKEIYQYLSDDAVFSEMFKEKMISGILPDFIRCNEGYSEEEKEEKLKTVALFHRFTSSFNDFFLNRKNVFTKEAIVTAIGYRVVHENAEIFLENMVAFQNIQKSAESQISIIERKNEHYFMEWKLSHIFTADYYMMLMTQKAIEHYNEMCGVVNQQMREYCQKEKKNWNLYRMKRLHKQILSNASTSFKIPEKYENDAEVYESVNSFLQNVMEKTVMERIAVLKNSTDNFDLSKIYITAPYYEKISNYLCGSWNTITDCLTHYYEQQIAGKGARKDQKVKAAVKADKWKSLSEIEQLLKEYARAEEVKRKPEEYIAEIENIVSLKEAHLLEYHPEVNLIENEKYATEIKDVLDNYMELFHWMKWFYIEEAVEKEVNFYGELDDLYEEIKDIVPLYNKVRNYVTQKPYSDTKIKLNFGTPTLANGWSKSKEYDYNAILLQKDGKYYMGIFNPIQKPEKEIIEGHSQPLEGNEYKKMVYYYLPSANKMLPKVLLSKKGMEIYQPSEYIINGYKERRHIKSEEKFDLQFCHDLIDYFKSGIERNSDWKVFGFDFSDTDTYQDISGFYREVEDQGYKIDWTYIKEADIDRLNEEGKLYLFQIYNKDFSEKSTGRENLHTMYLKNLFSEENVREQVLKLNGEAEIFFRKSSVKKPIIHKKGTMLVNRTYMEEVNGNSVRRNIPEKEYQEIYNYKNHRLKGELSTEAKKYLEKAVCHETKKDIVKDYRYSVDKFFIHLPITINYRASGKETLNSVAQRYIAHQNDMHVIGIDRGERNLIYVSVINMQGEIKEQKSFNIINEFNYKEKLKEREQSRGAARRNWKEIGQIKDLKEGYLSGVIHEIAKMMIKYHAIIAMEDLNYGFKRGRFKVERQVYQKFENMLIQKLNYLVFKDRPADEDGGVLRGYQLAYIPDSVKKMGRQCGMIFYVPAAFTSKIDPTTGFVDIFKHKVYTTEQAKREFILSFDEICYDVERQLFRFTFDYANFVTQNVTLARNNWTIYTNGTRAQKEFGNGRMRDKEDYNPKDKMVELLESEGIEFKSGKNLLPALKKVSNAKVFEELQKIVRFTVQLRNSKSEENDVDYDHVISPVLNEEGNFFDSSKYKNKEEKKESLLPVDADANGAYCIALKGLYIMQAIQKNWSEEKALSPDVLRLNNNDWFDYIQNKRYR

SEQ ID NO: 583 - protein, 1367 aa, Unknown
  source: /note="Description of Unknown: Cas12 variant sequence"
MEKSLNDFIGLYSVSKTLRFELKPVSETLENIKKFHFLEEDKKKANDYKDVKKIIDNYHKYFIDDVLKNASFNWKKLEEAIREYNKNKSDDSALVAEQKKLGDAILKLFTSDKRYKALTAATPKELFESILPDWFGEQCNQDLNKAALKTFQKFTSYFTGFQENRKNVYSAEAIPTAVPYRIVNDNFPKFLQNVLIFKTIQEKCPQIIDEVEKELSSYLGKEKLAGIFTLESFNKYLGQGGKENQRGIDFYNQIIGGVVEKEGGINLRGVNQFLNLYWQQHPDFTKEDRRIKMVPLYKQILSDRSSLSFKIESIENDEELKNALLECADKLELKNDEKKSIFEEVCDLFSSVKNLDLSGIYINRKDINSVSRILTGDWSWLQSRMNVYAEEKFTTKAEKARWQKSLDDEGENKSKGFYSLTDLNEVLEYSSENVAETDIRITDYFEHRCRYYVDKETEMFVQGSELVALSLQEMCDDILKKRKAMNTVLENLSSENKLREKTDDVAVIKEYLDAVQELLHRIKPLKVNGVGDSTFYSVYDSIYSALSEVISVYNKTRNYITKKAASPEKYKLNFDNPTLADGWDLNKEQANTSVILRKDGMFYLGIMNPKNKPKFAEKYDCGNESCYEKMIYKQFDATKQIPKCSTQKKEVQKYFLSGATEPYILNDKKSFKSELIITKDIWFMNNHVWDGEKFVPKRDNETRPKKFQIGYFKQTGDFDGYKNALSNWISFCKNFLQSYLSATVYDYNFKNSEEYEGLDEFYNYLNATCYKLNFINIPETEINKMVSEGKLYLFQIYNKDFASGSTGMPNMHTLYWKNLFSDENLKNVCLKLNGEAELFYRPAGIKEPVIHKEGSYLVNRTTEDGESIPEKIYFEIYKNANGKLEKLSDEAQNYISNHEVVIKKAGHEIIKDRHYTEPKFLFHVPLTINFKASGNSYSINENVRKFLKNNPDVNIIGLDRGERHLIYLSLINQKGEIIKQFTFNEVERNKNGRTIKVNYHEKLDQREKERDAARKSWQAIGKIAELKEGYLSAVIHQLTKLMVEYNAVVVMEDLNFGFKRGRFHVEKQVYQKFEHILIDKSNYLVFKDRGLNEPGGVLNGYQIAGQFESFQKLGKQSGMLFYVPAGYTSKIDPKTGFVSMMNFKDLTNVHKKRDFFSKFDNIHYDEANGSFVFTFDYKKFDGKAKEEMKLTKWSVYSRDKRIVYFAKTKSYEDVLPTEKLQKIFESNGIDYKSGNNIQDSVMAIGADLKEGAKPSKEISDFWDGLLSNFKLILQMRNSNARTGEDYIISPVMADDGTFFDSREEFKKGEDAKLPLDADANGAYHIALKGLSLINKINLSKDEELKKFDMKISNADWFKFAQEKNYAK

SEQ ID NO: 584 - protein, 1229 aa, Unknown
  source: /note="Description of Unknown: Cas12 variant sequence"
MEEKKMSKIEKFIGKYKISKTLRFRAVPVGKTQDNIEKKGILEKDKKRSEDYEKVKAYLDSLHRDFIENTLKKVKLNELNEYACLFFSGTKDDGDKKKMEKLEEKMRKTISNEFCNDEMYKKIFSEKILSENNEEDVSDIVSSYKGFFTSLNGYVNNRKNLYVSDAKPTSIAYRCINENLPKFLRNVECYKKVVQVIPKEQIEYMSNNLNLSPYRIEDCFNIDFFEFCLSQGGIDLYNTFIGGYSKKDGTKVQGINEIVNLYNQKNKKDKEKYKLPQFTPLFKQILSDRDTKSFSIEKLENIYEVVELVKKSYSDEMFDDIETVFSNLNYYDASGIYVKNGPAITHISMNLTKDWATIRNNWNYEYDEKHSTKKNKNIEKYEDTRNTMYKKIDSFTLEYISRLVGKDIDELVKYFENEVANFVMDIKKTYSKLTPLFDRCQKENFDISEDEVNDIKGYLDNVKLLESFMKSFTINGKENNIDYVFYGKFTDDYDKLHEFDHIYNKVRNYITTSRKPYKLDKYKLYFDNPQLLGGWDINKEKDYRTVMLTKDGKYYFAIIDKGEHPFDNIPKDYFDNNGYYKKIIYRQIPNAAKYLSSKQIVPQNPPEEVKRILDKKKADSKSLTEEEKNIFIDYIKSDFLKNYKLLFDKNNNPYFNFAFRESSTYESLNEFFEDVERQAYSVRYENLPADYIDNLVNEGKIYLFEIYSKDFSEYSKGTNNLHTMYFKALFDNDNLKNTVFKLSGNAELFIRPASIKKDELVIHPKNQLLQNKNPLNPKKQSIFDYDLVKDKRFFENQYMLHISIEINKNERDAKKIKNINEMVRKELKDSDDNYIIGIDRGERNLLYVCVINSAGKIVEQMSLNEIINEYNGIKHTVDYQGLLDKCEKERNAQRQSWKSIENIKELKDGYISQVVHKLCQLVEKYDAIIAMENLNGGFKRGRTKFEKQVYQKFENKLINKMEYMADKKRKTTENGGILRGYQLTNGCINNSYQNGFIFYVPAWLTSKIDPTTGFVDLLKPKYTNVEEAHLWINKFNSITYDKKLDMFAFNINYSQFPRADIDYRKIWTFYTNGYRIETFRNSEKNNEFDWKEVHLTSVIKKLLEEYQINYISGKNIIDDLIQIKDKPFWNSFIKYIRLTLQMRNSITGRTDVDYIISPVINNEGTFYDSRKDLDEITLPQDADANGAYNIARKALWIIEKLKESPDEELNKVKLAITQREWLEYAQINI

SEQ ID NO: 585 - protein, 1261 aa, Unknown
  source: /note="Description of Unknown: Cas12 variant sequence"
MIIHNCYIGGSFMKKIDSFTNCYSLSKTLRFKLIPIGATQSNFDLNKMLDEDKKRAENYSKAKSIIDKYHRFFIDKVLSSVTENKAFDSFLEDVRAYAELYYRSNKDDSDKASMKTLESKMRKFIALALQSDEGFKDLFGQNLIKKTLPEFLESDTDKEIIAEFDGFSTYFTGFFNNRKNMYSADDQPTAISYRCINDNLPKFLDNVRTFKNSDVASILNDNLKILNEDFDGIYGTSAEDVFNVDYFPFVLSQKGIEAYNSILGGYTNSDGSKIKGLNEYINLYNQKNENIHRIPKMKQLFKQILSERESVSFIPEKFDSDDDVLSSINDYYLERDGGKVLSIEKTVEKIEKLFSAVTDYSTDGIFVKNAAELTAVCSGAFGYWGTVQNAWNNEYDALNGYKETEKYIDKRKKAYKSIESFSLADIQKYADVSESSETNAEVTEWLRNEIKEKCNLAVQGYESSKDLISKPYTESKKLFNNDNAVELIKNALDSVKELENVLRLLLGTGKEESKDENFYGEFLPCYERICEVDSLYDKVRNYMTQKLYKTDKIKLNFQNPQFLGGWDRNKEADYSAVLLRRNSLYYIAIMPSGYKRVFEKIPAPKADETVYEKVIYKLLPGPNKMLPKVFFSKKGIETFNPPKEILEKYELGTHKTGDGFNLDDCHALIDYFKSALDVHSDWSNFGFRFSDTSTYKNIADFYNEVKNQGYKITFCDVPQSYINELVDEGKLYLFQLYNKDFSEHSKGTPNLHTLYFKMLFDERNLENVVFKLNGEAEMFYREASISKDDMIVHPKNQPIKNKNEQNSRKQSTFEYDIVKDRRYTVDQFMLHIPITLNFTANGGTNINNEVRKALKDCDKNYVIGIDRGERNLLYICVVDSEGRIIEQYSLNEIINEYNGNTYSTDYHALLDKKEKERLESRKAWKTVENIKELKEGYISQVVHKICELVEKYDAVIVMEDLNLGFKQGRSGKFEKSVYQKFEKMLIDKLNYFADKKKSPEEIGSVLNAYQLTNAFESFEKMGKQNGFIFYVPAYLTSKIDPTTGFADLLHPSSKQSKESMRDFVGRFDSITFNKTENYFEFELDYNKFPRCNTDYRKKWTVCTYGSRIKTFRNPEKNSEWDNKTVELTPAFMALFEKYSIDVNGDIKAQIMSVDKKDFFVELIGLLRLTLQMRNSETGKVDRDYLISPVKNSEGVFYNSDDYKGIENASLPKDADANGAYNIARKGLWIIEQIKACENDAELNKIRLAISNAEWLEYAQKK

SEQ ID NO: 586 - protein, 1242 aa, Unknown
  source: /note="Description of Unknown: Cas12 variant sequence"
MKEQFVNQYPISKTLRFSLIPIGKTEENFNKNLLLKEDEKKAEEYQKVKGYIDRYHKFFIETALCNINFEGFEEYSLLYYKCSKDDNDLKTMEDIEIKLRKQISKTMTSHKLYKDLFGENMIKTILPNFLDSDEEKNSLEMFRGFYTYFSGFNTNRKNMYTEEAKSTSIAYRCINDNLPKFLDNSKSFEKIKCALNKEELKAKNEEFYEIFQIYATDIFNIDFFNFVLTQPGIDKYNGIIGGYTCSDGTKVQGLNEIINLYNQQIAKDDKSKRLPLLKMLYKQILSDRETVSFIPEKFSSDNEVLESINNYFSKNVSNAIKSLKELFQGFEAYNMNGIFISSGVAITDLSNAVFGDWNAISTAWEKAYFETNPPKKNKSQEKYEEELKANYKKIKSFSLDEIQRLGSIAKSPDSIGSVAEYYKITVTEKIDNITELYDGSKELLNCNYSESYDKKLIKNDTVIEKVKTLLDAVKSLEKLIKPLVGTGKEDKDELFYGTFLPLYTSLSAVDRLYDKVRNYATQKPYSKDKIKLNFNCSSFLSGWATDYSSNGGLIFEKDGLYYLGIVNKKFTTEEIDYLQQNADENPAQRIVYDFQKPDNKNTPRLFIRSKGTNYSPSVKEYNLPVEEIVELYDKRYFTTEYRNKNPELYKASLVKLIDYFKLGFTRHESYRHYDFKWKKSEEYNDISEFYKDVEISCYSLKQEKINYNTLLNFVAENRIYLFQIYNKDFSKYSKGTPNLHTRYFKALFDENNLSDVVFKLNGGSEMFFRKASIKDNEKVVHPANQPIDNKNPDNSKKQSTFDYELIKDKRFTKHQFSIHIPITMNFKARGRDFINNDIRKAIKSEYKPYVIGIDRGERNLIYISVINNNGEIVEQMSLNDIISDNGYKVDYQRLLDRKEKERDNARKSWGTIENIKELKEGYISQVIHKICELVIKYDAVIAMEDLNFGFKRGRFNVEKQVYQKFENMLISKLNYLCDKKSEANSEGGLLKAYQLTNKFDGVNKGKQNGIIFYVPAWLTSKIDPVTGFVDLLHPKYISVEETHSLFEKLDDIRYNFEKDMFEFDIDYSKLPKCNADFKQKWTVCTNADRIMTFRNSEKNNEWDNKRILLSDEFKRLFEEFGIDYCHNLKNKILSISNKDFCYRFIKLFALTMQMRNSITGSTNPEDDYLISPVRDENGVFYDSRNFIGSKAGLPIDADANGAYNIARKGLWAINAIKSTADDMLDKVDLSISNAKWLEYVQK

SEQ ID NO: 587 - protein, 1307 aa, Unknown
  source: /note="Description of Unknown: Cas12 variant sequence"
MADLSQFTHKYQVPKTLRFELIPQGKTLENLSAYGMVADDKQRSENYKKLKPVIDRIYKYFIEESLKNTNLDWNPLYEAIREYRKEKTTATITNLKEQQDICRRAIASRFEGKVPDKGDKSVKDFNKKQSKLFKELFGKELFTDSVLEQLPGVSLSDEDKALLKSFDKFTTYFVGFYDNRKNVFSSDDISTGIPHRLVQENFPKFIDNCDDYKRLVLVAPELKEKLEKAAEATKIFEDVSLDEIFSIKFYNRLLQQNQIDQFNQLLGGIAGAPGTPKIQGLNETLNLSMQQDKTLEQKLKSVPHRFSPLYKQILSDRSSLSFIPESFSCDAEVLLAVQEYLDNLKTEHVIEDLKEVFNRLTTLDLKHIYVNSTKVTAFSQALFGDWNLCREQLRVYKMSNGNEKITKKALGELESWLKNSDIAFTELQEALADEALPAKVNLKVQEAISGLNEQMAKSLPKELKIPEEKEELKALLDAIQEVYHTLEWFIVSDDVETDTDFYVPLKETLQIIQPIIPLYNKVRNFATQKPYSVEKFKLNFANPTLADGWDENKEQQNCAVLFQKGNNYYLGILNPKNKPDFDNVDTEKQGNCYQKMVYKQFPDFSKMMPKCTTQLKEVKQHFEGKDSDYILNNKNFIKPLTITREVYDLNNVLYDGKKKFQIDYLRKTKDEDGYYTALHTWIDFAKKFVASYKSTSIYDTSTILPPEKYEKLNEFYGALDNLFYQIKFENIPEEIIDTYVEDGKLFLFQIYNKDFAAGATGAPNLHTIYWKAVFDPENVKDVVVKLNGQAELFYRPKSNMDVIRHKVGEKLVNRTLKDGSILTDELHKELYLYANGSLKKGLSEDAKIILDKNLAVIYDVHHEIVKDRRFTTDKFFFHVPLTLNYKCDKNPVKFNAEVQEYLKENPDTYVIGIDRGERNLIYAVVIDPKGRIVEQKSFNVINGFDYHGKLDQREKERVKARQAWTAVGKIKELKQGYLSLVVHEISKMMVRYQAVVVLENLNVGFKRVRSGIAEKAVYQQFEKMLINKLNYLMFKDAGGTEPGSVLNAYQLTDRFESFAKMGLQTGFLFYIPAAFTSKIDPATGFVDPFRWGAIKTLADKREFLSGFESLKFDSTTGNFILHFDVSKNKNFQKKLEGFVPDWDIIIEANKMKTGKGATYIAGKRIEFVRDNNSQGHYEDYLPCNALAETLRQCDIPYEEGKDILPLILEKNDSKLLHSVFKVVRLTLQMRNSNAETGEDYISSPVEDVSGSCFDSRMENEKLPKDADANGAYHIALKGMLALERLRKDEKMAISNNDWLNYIQEKRA

SEQ ID NO: 588 - protein, 1286 aa, Unknown
  source: /note="Description of Unknown: Cas12 variant sequence"
MTNFDNFTKKYVNSKTIRLEAIPVGKTLKNIEKMGFIAADRQRDEDYQKAKSVIDHIYKAFMDDCLKDLFLDWDPLYEAVVACWRERSPEGRQALQIMQADYRKKIADRFRNHELYGSLFTKKIFDGSVAQRLPDLEQSAEEKSLLSNFNKFTSYFRDFFDKRKRLFSDDEKHSAIAYRLINENFLKFVANCEAFRRMTERVPELREKLQNTGSLQVYNGLALDEVFSADFYNQLIVQKQIDLYNQLIGGIAGEPGTPNIQGLNATINLALQGDSSLHEKLAGIPHRFNPLYKQILSDVSTLSFVPSAFQSDGEMLAAVRGFKVQLESGRVLQNVRRLFNGLETEADLSRVYVNNSKLAAFSSMFFGRWNLCSDALFAWKKGKQKKITNKKLTEIKKWLKNSDIAIAEIQEAFGEDFPRGKINEKIQAQADALHSQLALPIPENLKALCAKDGLKSMLDTVLGLYRMLQWFIVGDDNEKDSDFYFGLGKILGSLDPVLVLYNRVRNYITKKPYSLTKFRLNFDNSQLLNGWDENNLDTNCASIFIKDGKYYLGISNKNNRPQFDTVATSGKSGYQRMVYKQFANWGRDLPHSTTQMKKVKKHFSASDADYVLDGDKFIRPLIITKEIFDLNNVKFNGKKKLQVDYLRNTGDREGYTHALHTWINFAKDFCACYKSTSIYDISCLRPTDQYDNLMDFYADLGNLSHRIVWQTIPEEAIDNYVEQGQLFLFQLYNKDFAPGADGKPNLHTLYWKAVFNPENLEDVVVKLNGKAELFYRPRSNMDVVRHKVGEKLVNRKLKNGLTLPSRLHEEIYRYVNGTLNKDLSADARSVLPLAVVRDVQHEIIKDRRFTADKFFFHASLTFNFKSSDKPVGFNEDVREYLREHPDTYVVGVDRGERNLIYIVVIDPQGNIVEQRSFNMINGIDYWSLLDQKEKERVEAKQAWETVGKIKDLKCGYLSFLIHEITKIIIKYHAVVILENLSLGFKRVRTGIAEKAVYQQFERMLVTKLGYVVFKDRAGKAPGGVLNAYQLTDNTRTAENTGIQNGFLFYVPAAFTSRVDPATGFFDFYDWGKIKTATDKKNFIAGFNSVRYERSTGDFIVHVGAKNLAVRRVAEDVRTEWDIVIEANVRKMGIDGNSYISGKRIRYRSGEQGHGQYENHLPCQELIRALQQYGIQYETGKDILPAILQQDDAKLTDTVFDVFRLALQMRNTSAETGEDYFNSVVRDRSGRCFDTRRAEAAMPKEADANDAYHIALKGLFVLEKLRKGESIGIKNTEWLRYVQQRHS

SEQ ID NO: 589 - protein, 1264 aa, Unknown
  source: /note="Description of Unknown: Cas12 variant sequence"
MENYGGFTGLYPLQKTLKFELRPQGRTMEHLVSSNFFEEDRDRAEKYKIVKKVIDNYHKDFINECLSKRSFDWTPLMKTSEKYYASKEKNGKKKQDLDQKIIPTIENLSEKDRKELELEQKRMRKEIVSVFKEDKRFKYLFSEKLFSILLKDEDYSKEKLTEKEILALKSFNKFSGYFIGLHKNRANFYSEGDESTAIAYRIVNENFPKFLSNLKKYREVCEKYPEIIQDAEQSLAGLNIKMDDIFPMENFNKVMTQDGIDLYNLAIGGKAQALGEKQKGLNEFLNEVNQSYKKGNDRIRMTPLFKQILSERTSYSYILDAFDDNSQLITSINGFFTEVEKDKEGNTFDRAVGLIASYMKYDLSRVYIRKADLNKVSMEIFGSWERLGGLLRIFKSELYGDVNAEKTSKKVDKWLNSGEFSLSDVINAIAGSKSAETFDEYILKMRVARGEIDNALEKIKCINGNFSEDENSKMIIKAILDSVQRLFHLFSSFQVRADFSQDGDFYAEYNEIYEKLFAIVPLYNRVRNYLTKNNLSMKKIKLNFKNPALANGWDLNKEYDNTAVIFLREGKYYLGIMNPSKKKNIKFEEGSGTGPFYKKMAYKLLPDPNKMLPKVFFAKKNINYYNPSDEIVKGYKAGKYKKGENFDIDFCHKLIDFFKESIQKNEDWRAFNYLFSATESYKDISDFYSEVEDQGYRMYFLNVPVANIDEYVEKGDLFLFQIYNKDFASGAKGNKDMHTIYWNAAFSDENLRNVVVKLNGEAELFYRDKSIIEPICHKKGEMLVNRTCFDKTPVPDKIHKELFDYHNGRAKTLSIEAKGYLDRVGVFQASYEIIKDRRYSENKMYFHVPLKLNFKADGKKNLNKMVIEKFLSDKDVHIIGIDRGERNLLYYSVIDRRGNIIDQDSLNIIDGFDYQKKLGQREIERREARQSWNSIGKIKDLKEGYLSKAVHKVSKMVLEYNAIVVLEDLNFGFKRGRFKVEKQVYQKFEKMLIDKLNYLVFKEVLDSRDAGGVLNAYQLTTQLESFNKLGKQSGILFYVPAAYTSKIDPTTGFVSLFNTSRIESDSEKKDFLSGFDSIVYSAKDGGIFAFKFDYRNRNFQREKTDHKNIWTVYTNGDRIKYKGRMKGYEITSPTKRIKDVLSSSGIRYDDGQELRDSIIQSGNKVLINEVYNSFIDTLQMRNSDGEQDYIISPVKNRNGEFFRTDPDRRELPVDADANGAYHIALRGELLMQKIAEDFDPKSDKFTMPKMEHKDWFEFMQTRGD

SEQ ID NO: 590 - protein, 1232 aa, Unknown
  source: /note="Description of Unknown: Cas12 variant sequence"
MLHAFTNQYQLSKTLRFGATLKEDEKKCKSHEELKGFVDISYENMKSSATIAESLNENELVKKCERCYSEIVKFHNAWEKIYYRTDQIAVYKDFYRQLSRKARFDAGKQNSQLITLASLCGMYQGAKLSRYITNYWKDNITRQKSFLKDFSQQLHQYTRALEKSDKAHTKPNLINFNKTFMVLANLVNEIVIPLSNGAISFPNISKLEDGEESHLIEFALNDYSQLSELIGELKDAIATNGGYTPFAKVTLNHYTAEQKPHVFKNDIDAKIRELKLIGLVETLKGKSSEQIEEYFSNLDKFSTYNDRNQSVIVRTQCFKYKPIPFLVKHQLAKYISEPNGWDEDAVAKVLDAVGAIRSPAHDYANNQEGFDLNHYPIKVAFDYAWEQLANSLYTTVTFPQEMCEKYLNSIYGCEVSKEPVFKFYADLLYIRKNLAVLEHKNNLPSNQEEFICKINNTFENIVLPYKISQFETYKKDILAWINDGHDHKKYTDAKQQLGFIRGGLKGRIKAEEVSQKDKYGKIKSYYENPYTKLTNEFKQISSTYGKTFAELRDKFKEKNEITKITHFGIIIEDKNRDRYLLASELKHEQINHVSTILNKLDKSSEFITYQVKSLTSKTLIKLIKNHTTKKGAISPYADFHTSKTGFNKNEIEKNWDNYKREQVLVEYVKDCLTDSTMAKNQNWAEFGWNFEKCNSYEDIEHEIDQKSYLLQSDTISKQSIASLVEGGCLLLPIINQDITSKERKDKNQFSKDWNHIFEGSKEFRLHPEFAVSYRTPIEGYPVQKRYGRLQFVCAFNAHIVPQNGEFINLKKQIENFNDEDVQKRNVTEFNKKVNHALSDKEYVVIGIDRGLKQLATLCVLDKRGKILGDFEIYKKEFVRAEKRSESHWEHTQAETRHILDLSNLRVETTIEGKKVLVDQSLTLVKKNRDTPDEEATEENKQKIKLKQLSYIRKLQHKMQTNEQDVLDLINNEPSDEEFKKRIEGLISSFGEGQKYADLPINTMREMISDLQGVIARGNNQTEKNKIIELDAADNLKQGIVANMIGIVNYIFAKYSYKAYISLEDLSRAYGGAKSGYDGRYLPSTSQDEDVDFKEQQNQMLAGLGTYQFFEMQLLKKLQKIQSDNTVLRFVPAFRSADNYRNILRLEETKYKSKPFGVVHFIDPKFTSKKCPVCSKTNVYRDKDDILVCKECGFRSDSQLKERENNIHYIHNGDDNGAYHIALKSVENLIQMK

SEQ ID NO: 591 - protein, 1067 aa, Unknown
  source: /note="Description of Unknown: Cas12 variant sequence"
MKNGINLFKTKTTKTKGVDMEKYQITKTIRFKLLPDNAHEIVEKVKSLKTSNVDELMDEVKNVHLKGLELLFALKKYFYFDGNQCKSFKSTLEIKARWLRLYTPDQYYLKKSSKNSYQLKSLSYFKDVFNDWLFNWEESVSELAIIYEKYKICQHQRDSRADIALLIKKLSMKEYFPFISDLIDCVNDKNSNKTFLMKLSEELSVLLEKCNSRALPYQSNGIVVGKASLNYYTVSKSEKMLQNEYEDVCQSLDKNYDITEMKVILYKEKLDNLNFKDVTIANAYNLLKENKALQKRLFSEYVSQGKVLSLIKTELPLFSNINDNDFEKYKEWSNEIKKLADKKNTFCKKTQQDKIKDIQNKISELKKKRGALFQYKFTSFQKHCDNYKKVAVQYGKLKARKKAIEKDEIEANLLRYWSVILEQEDKHSLVLIPKNNAKDAKQYIETINTKGGKYIIHHLDSLTLRALNKLCFNAVDIEKGQMVRENTFYQGIKEEFERNKINCDNQGVLKIQGLYSFKTEGGQINEKEAVEFFKEVLKSNYAREVLNLPYDLESNIFQKEYTNLDQFRQDLEKCCYALHSKIGKDDLDEFTRRFEAQVFDITSIDLKSKKEKTKTTGEMKKHTQLWLEFWKGAIEQNFATRVNPELSIFWRAPKSSREKKYGKGSDLYDPNKNNRYLYEQYTLALTITENAGSHFKDIAFKDTSKIKEAIKEFNMSLSQSKYCFGIDRGNAELVSLCLIKNEKDFPFEKFPVYRLRDLTYQGDFKDKHDQMRYGVAIKNISYFIDQEDLFEKNNLSAIDMTTAKLIKNKIVLNGDVLTYLKLKEETAKHKLTQFFQGSSINKNSRVYFDEDENVFKITTNRNHNPEEIIYFYRGEYGAIKNKNDLEDILNEYLCKMETGESEIVLLNRVNHLRDAISANIVGILSYLIDLFPETIVALENLAKGTIDRHVSQSYENITRRFEWALYRKLLNKQLAPPELKENILLREGDDKIDQFGIIHFVEEKNTSKDCPNCRKTTQQTNDNKFKEKKFVCKSCGFDTSKDRKGMDSLNSPDTVAAYNVARKKFES

SEQ ID NO: 592 - protein, 1309 aa, Unknown
  source: /note="Description of Unknown: Cas12 variant sequence"
MAKETKEFKTFDDFTNLYEVQKTLRFELEAVPETEIVLENRGIWYKRDKKRADEKPIVKFYMDILHREFTDEALEKIKESGVLNLSGYFKLFEELRRLQNHGANTKEEKKLKLEEIRAKKREISNELSQIRRVFSVRGFDVVDSDWKKKYTIEGKKIKNDKSKTYLILSENILNFLENRFTSKEVERLRSIDKKHVEDYGNVVNSGGENIFATFKGFFGYFDSLIKNRENFYETDGKAGRVATRSVDENLNFFAENLHIFSTDLPKALKDDLSDTQKAIFERSYYKNCLLQKDIKSYNLIIGDINKEINKHRQQRDTKIKFLNTLFKQILSIEEKEQYKHIEINNDEDLIRAIRDFISLNESKISEGTKIFNQFIQRCLQKEDLGQIYLPKDSVNTIAHRIFKPWDEIMALFDRKYFVSLEEIKDLTESSVWKERVLEESKTKSLIFKDTHIHTIISGQEIFSNFILILEKEYKNQFSGFISETRRGKAAFVGYDESLKNLRATIKWFEGKNLKLSETEKVEWIKAIKDYADAALRIFQMTKYLWLPVVGDEEDKDYLRIKAEIDQLTKDNDFYNKINAFIDGYKPEPFIYRSSFQEYLTRRPFSTDKFKINFENSRLLDGWDKDMIDDRMGILLQRDGDYFLGILNKEDRHCLDNLVDVKSEDKNSYALMQFKQLTGLYRQLPRMAFPKKKQPVLEANAEIKKIKEDFDFLQKQKKEREVNVNVVFDNKKLNLLINHYAEFLKENYKDEKCYDFSLLNKEKVYESLSDFYADVDKITYSLSFIQVSIDQLIKTGKILLFRLKNKDLLKGSLGQNKNLHTYYFHALFERENLSQGRIRLGAQAEIFFRPASIEKEKDKNRSNALKKSPKTRYVKEILKNKRYSEDKVFLHLPIQLNADAYDLPSINQNVFEFIKNRQEKVKIIGIDRGEKNLAYYSVISQNSNGKIKIEEPPRDLNLGYLEPLDELENKRQDERKAWQSISEIKSKRDGYISYAVSKIVELMLKYQAIIVLEDLSGKFKRSRMKFEKAPYQQLELALIKKLNYLVKKNSKSGKPGHYLSAYQLTEPVGSYKEMGKQTGIIFYTQAGYTSRTCPTCGWRKRVQGLYYKDRTSAQRRFDPKTGVKIFYDSVNDRFVFQYHPVYEQKELKEWDKEIYSDVTRIRWNNEEKKNNEYRKGDITLKIKRLFRDRGIDLSRNINEQLVNVGDASFWEELINLLRLITEIRNIDNENNRDFIECPHCHFQSENGFHGVAWNGDANGAYNIARKGLLITKAVCDPEKNVGDITWSDLKVDMKDWDAATDEWAKKNPEK

SEQ ID NO: 593 - protein, 1456 aa, Unknown
  source: /note="Description of Unknown: Cas12 variant sequence"
MENEKIFSDLTNRYQVVKTLPFELKPVPRTRVLLGLDNPNKGEIFSKDRERAENFTIIKKYIDRLHSLFINESLKKADIDFSNFYKQYGKNINTKNNKNIDDDNDINDDEKEDSENDNLKKYRQEIANLFNKSKYKSWVNVGKDGDKISGMLFEKGLIDLLRTHFSDNLNEDIEIPELFSNKKIKDTRKLKEIINSFGKDGKDGQNFTTYFSVSFHNNRKNYYKSDGKMGRVSTRIVDENLERFCKNIYLYKEIIGKNEIKEIFSGNWDIYLQKKPNFSNDKTYKKLDEFKNDKYDWEMIFRDVNSYNKYFLQSDIEFYNYIRGKLNQDINEYNGKKRDSKEKINSQFENLRNQVHGEKKNYDDDFEIDEDNIIQFINEIFVRHNQNKMRFSEKLFSDFIDLLMVDNGDKLDKVYFSQKAVENAIARYYFVEETTNEGREPLLISLLLQNAGKDRKKLSNKPIKLGDIKFVLDQANNKPAEDIFKNRYVLSESNNDGIINANDKNHWANLLRLIKKDFYFHKDNLIKSQDKLALETKYNKGSDEGERQIETIKNFAESAKAILRMTKYFDLRKNGVIQNVIGGKDPIHEEVDKYFDGDVLSGEESCRISKYYDALRNFITKKAWSADKIILNFDCSEFLGGWDRSQEQKKRGIILRHRDGDEERYYLAVLGKNGKQYFENRTLFKGCESSDWQKIEYNVIQKPHMSLPKNLITPFFKKDKITNERFIDRSKKGAKALIEIDINPSDEFLNNYNLGKHTKENLDKSFLCDYFKYLMDAIAKYYKGEFNFNFPDVSNFDNTQPFYSFIEKNAYSIKYFGISSKEIEKLIADCYYKEDVYLFQIYCKDFEIDPKIGKAKYGNEFRTKAEIRKSKGEEAGNENLNTKYFKLLFDEKNLKNQNGIVYKLNGGAKMFYRPSSIKKDEKIDGKWRYKEDKYSLNITITCNFSSKKDDLSIDKDINKKIAEVNANSDFRIISIDRGEKNLAYCCVMDENANILDIKSLNRITRYDKNGKAIKEKNMFHEVKDGKLCYGEPVYDFYKDYQNLLDEREIKRLVNRRSWNVIEDIKNLKKGYVALLINYICKAVVIAINEGKYPIIVLESLDKGMLHNRVKIEKQIYRGVEEGLVRKLNYFVDKKTDNVLNAWQLLAKFETVGSSLDRKKQLGIIFYVDPGYTSITCPCCGFRQRKYIKAERAEENFKEIKIKFDGKRYSFAYDYRCIDDNGKEKSKEDIIYSNVKRLLRSGRNGRAVQIEDVTDELTNLFKKHNINIEQDINEQLAGKDNKFWKQLLWWFNAIEQIRNTQSLRRKFNTEENKLEILENNDCDFILCPHCYFDSNKDKFQNKIWNGDANGAFNIGRKGIIDIFEIKKHQRMLSDFMEQWGIDKLPKANGGNQAVIEIVKNDKKYNLCILNNKKIPYYCLRIGKEKIDSIADDRKCNQLPDLMVNWKKWDMWLDKWGK

SEQ ID NO: 594 - protein, 1486 aa, Unknown
  source: /note="Description of Unknown: Cas12 variant sequence"
MPEVKNVFQDFTNLYELSKTLRFELKPVPETEKILELNAAKTKKFPKDLYRAENFEIIKKYTDELHRTYIRETLNNVNIDYLKFLEIFRINGKKKNEMTDENEESDENNEKDDIQKIKKELRSKIGNLFNKWNNDKDNKFKDWVKIDVGKKEKEVSGDLFGKELITILKNYFKNKLDSKVNVPMLFFNEQEIKNGEAKKQRKLEAVFENFDKFTTYFTDSFYNNRKNYYKTEGRVGQVATRIIDENLPRFCSNLIAFNEVVSLYSTLLNNFDLGWKEYLNEKKINQTWVEKFELSNYDWKALFNDVNYYNQCLLQEGIDKYNYIIKKLNKDINEYTQNKYKSVEKGNNNNPDINFFQKLHKQIHGERDFKLIEIDIDENNIFTKILPEFILHSDMKLMTKIDEEVGVEEIVGAERIIKIFIKQELKDLEKIYLSRRAIETISAKWFHSWETLKDLILGYLNKDLLESKKRKKVPDFVDFNIIKIVLENNKDDYKDLFKRKYFEADKNEFVDWIDSSGGTKKLEFGGENWINFLNVFEYEFGTLLTEYKKNKNALLYLIDKKIDYDKNNEVGQTAAIKNFADSALGIFRMVSYFALRKKGVMVEPKNGKDEIFYAFVDRYLDGDDNDREEQNKIVQYYNTLRNFVTQKAWSIDKVRLCFDCGEFLKGWDKDKIHERLGIILRNNNKFYLGILNKNHKQIFIKIKSHDNNNFYYVIYDYKQLNNVYRQIPRLAFPSRSVKKGDAYMLRAIQERKKKFFLEDEEFIELQEIKNEYDKIGNDLSKEKLTKLIEYYKKVVISNYSSLYNVSNLNNKKFNSINEFNQYVENLMYSLIPTRISPDFIKEKISKGELYLFQIYNKDFELDESIGKEKFGEDFAPVIMDGKNNLHTEYFKLLFNDSNLKNPNGVVFKLSGGAKMFYRPATENLPIKKDRDGNIIKNKKGENVIVGQRYKEDKYFLHLPIILNFVNKGKNYSINDMVNKAITNASDDQDKFRIIGLDRGEKHLVYYSVINERQEIIEIGSLNNISRKDNKGEIIEEKNWYHDKFGNIEKEPTKEYHKDYHNLLDQREIERLKSRQSWEKIENIKELKEGYISAVINKICNLVIKAIKENKIPIVALENLNSGMKRGRIKIDKQIYQKLELKLAKKLNFLVDKKEKNYLSAWQFTPKIETFSGDIEKKNQVGIIFYVDPAFTSATCPNCGFRKRIKMDPQNAKKKIKDMEITYENGIYKFDYPIENGENDVVYSDVERLKWDNEKKKVIKTKNVSDDFGKLFEDIKDKNNLKKELLSIGEENKEFWKEFSRCFNLLLRIRNSKLIKRKLNDDTGKVEIIADDDLADRDRDFIYCPQCHFHSEGGDVFGEFVKKKYLGKDNFEFNGDANGAYNIARKTIIAVNKIKDYQLGLNHFIEKYRISELPNNGKDKKNIFYNNNSYILSFFEVQDEKFRKVKVYGLKKDGDRQIIQKKEMWYRRYPDIFVNNKEWDKFVQNKS

SEQ ID NO: 595 - protein, 1403 aa, Unknown
  source: /note="Description of Unknown: Cas12 variant sequence"
MLFFMSTDITNKPREKGVFDNFTNLYEFSKTLTFGLIPLKWDDNKKMIVEDEDFSVLRKYGVIEEDKRIAESIKIAKFYLNILHRELIGKVLGSLKFEKKNLENYDRLLGEIEKNNKNENISEDKKKEIRKNFKKELSIAQDILLKKVGEVFESNGSGILSSKNCLDELTKRFTRQEVDKLRRENKDIGVEYPDVAYREKDGKEETKSFFAMDVGYLDDFHKNRKQLYSVKGKKNSLGRRILDNFEIFCKNKKLYEKYKNLDIDFSEIERNFNLTLEKVFDFDNYNERLTQEGLDEYAKILGGESNKQERTANIHGLNQIINLYIQKKQSEQKAEQKETGKKKIKFNKKDYPTFTCLQKQILSQVFRKEIIIESDRDLIRELKFFVEESKEKVDKARGIIEFLLNHEENDIDLAMVYLPKSKINSFVYKVFKEPQDFLSVFQDGASNLDFVSFDKIKTHLENNKLTYKIFFKTLIKENHDFESFLILLQQEIDLLIDGGETVTLGGKKESITSLDEKKNRLKEKLGWFEGKVRENEKMKDEEEGEFCSTVLAYSQAVLNITKRAEIFWLNEKQDAKVGEDNKDMIFYKKFDEFADDGFAPFFYFDKFGNYLKRRSRNTTKEIKLHFGNDDLLEGWDMNKEPEYWSFILRDRNQYYLGIGKKDGEIFHKKLGNSVEAVKEAYELENEADFYEKIDYKQLNIDRFEGIAFPKKTKTEEAFRQVCKKRADEFLGGDTYEFKILLAIKKEYDDFKARRQKEKDWDSKFSKEKMSKLIEYYITCLGKRDDWKRFNLNFRQPKEYEDRSDFVRHIQRQAYWIDPRKVSKDYVDKKVAEGEMFLFKVHNKDFYDFERKSEDKKNHTANLFTQYLLELFSCENIKNIKSKDLIESIFELDGKAEIRFRPKTDDVKLKIYQKKGKDVTYADKRDGNKEKEVIQHRRFAKDALTLHLKIRLNFGKHVNLFDFNKLVNTELFAKVPVKILGMDRGENNLIYYCFLDEHGEIENGKCGSLNRVGEQIITLEDDKKVKEPVDYFQLLVDREGQRDWEQKNWQKMTRIKDLKKAYLGNVVSWISKEMLSGIKEGVVTIGVLEDLNSNFKRTRFFRERQVYQGFEKALVNKLGYLVDKKYDNYRNVYQFAPIVDSVEEMEKNKQIGTLVYVPASYTSKICPHPKCGWRERLYMKNSASKEKIVGLLKSDGIKISYDQKNDRFYFEYQWEQEHKSDGKKKKYSGVDKVFSNVSRMRWDVEQKKSIDFVDGTDGSITNKLKSLLKGKGIELDNINQQIVNQQKELGVEFFQSIIFYFNLIMQIRNYDKEKSGSEADYIQCPSCLFDSRKPEMNGKLSAITNGDANGAYNIARKGFMQLCRIRENPQEPMKLITNREWDEAVREWDIYSAAQKIPVLSEEN

SEQ ID NO: 596 - protein, 1356 aa, Unknown
  source: /note="Description of Unknown: Cas12 variant sequence"
MTIKKHKPFTNFECLTPVQKTLRFRLIPVGRTTEFVKCRNIIEADRKRSEMYPLLKELADRFYREFMTDQLSNLLFDWSPLVEALLLARNNTDPRENQRIASLVRDEQKKYRTLLLKRLSGQVDRNGTPLPKNTASVNKKYYDDLFKARFVTETLPAYLEHLKNKPDGRISDELFDAYKDALDSYQKFTSRLTNFWQARKNIFTDEDIATGFAYRIVHEIVPDYLFNRRVYEQHKLDFPEPLDLLETELKKKNLIANDESLDALFTIPAINRLLTQKGVDLHNAVIGGFFTDDHTKVQGFNELANLKNQTLKNVSDNSEIKPVGKMTRLKKHILSISESTSFLFEQIESDDDLLARIIEFNNTLSEPDIDGLSIADINDQLYNIMTGVDPSTILVHARNLNKLSHEASLSWNRLRDGLYQMATESPYREDERFKRYIDASEEERDLSKLKNDIYFSLQELQFALDQSIDLEEEATPTEDIFLPFEFPGMDLKSELTVLFRSIEQLISSETKLIGNPDAIATIKKYLDAIMARYSIWNLLSCEAVELQDDLFYPEYDRVMGSLSNIILLYNLARNYLSRKPSSKEKFRLNFDKPTLADGWSESKVPDNFSVLLRKDDLFYLGILKDRKAYRVLSYENCDETAKNIKGYYERMIYHFSPDAYRMIPKCSTARKDVKKHFGEQGETTGYTLYPGASNFVKPFTIPYEIYRLQTELVNDKKRYQADYLKQTEDEEGYRQAVTAWIDFCKSYLESYEGTSTFDYSHLLKSEDYEDVNQFYADVDRASYSIYFEKVSVDLIHTMVDRGDLYLFQLYNKDFSPHSTGKPNLHTMYWRALFSNDNLQNNTIKLNGQAELFYRPKQVEQPTVHLQGSYLLNRFDKHGDVIPAGLYCEIYNHINERHPEGYTLSEEATQGLLDGRFVYREAPFELVKDKRYTEDQLFLHVPLEFNWTASANVPFENLANEYIKKDSDLHIIGIDRGERNLLYYSVINLQGDIVKQGSLNTLIQQTTLKGETVERQIPYQSMLKQREDERAEARQNWQSIDRIKDLKEGYLSHVIYKLSRLIIKYHAIVVMENLNVGFKRGRFKVERQVYQKFEVALINKLNALSFKEYEPNELGGVMRPWQLARRVVSPEDTRSQNGIVFYVPASYTSIVDPVTGFANLFYLNRIRNKDLNSFYGHFQEIRYDHEFDRFIFRFNYADFGVFCRIKNVPSRTWNLVSGERKAFNPKRRMIEKRDTTDEIKKALEAHGIAYQNEQNLLPLLLENENLLARIHRSFRLVLQLRNSDSDRDDIVSPALDKENNTFDSGQQPYESSLPINADANGAYNIARKGLLLVDKVKNDKRAVLSNREWFEYLMAEE

SEQ ID NO: 597 - protein, 1296 aa, Unknown
  source: /note="Description of Unknown: Cas12 variant sequence"
MENKDYSLSRFTKQYQNSKTVRFALTPIGRTEEYIIQNQYIEAARRKNQAYKIVKPIIDEKFRSMIDDVLTHCEKQDWVTLDKLILQYQNNKCRENMDALAEQQEEIRKNISEEFTKSDEYKNFFGKEDSKKLFKIFLPEYLNQINASESDKEAVNEFQKFKTYFSNFLIVRADIFKADNKHNTIPYRIVNENFMIFAGNKRTFSNIIRLIPNALEEIAKDGMKKEEWSFYNIQNVDSWFEPDSFQMCMSQKGIQKYNFIIGLVNSYINLYTQQNPQATEVKRSRLKLRMLHKQILSDRVNPSWLPEQFKEGEEGEKQIYEAILALENDLIKNCFDKKYDLWIQSIDIQNPRIYIAASEMARVSSALHMGWNGLNDVRKTILLKSDKKQAKVEKILKQDVSLKDLSDTLNRYADIYKEEQIPSLYQYIEYGSELLQDCAITRKEYHDLLNGNSNTLSLNQNEKLIEGLKAYLDSYQAIVHFLNVFIVGDELDKDTDFYAELDGLVESLSEIVPLYNKVRNYITRKVYSLDKMRIMFERSDFLGGWGQSFDTKEALLFQKDNLYYIGIIEKKYTNMDVEYLHEGIKEGNRAIRFIYNFQKADNKNIPRTFIRSKGTNYAPAVRKYNLPIESIIDIYDVGKFKTNYKKINEKEYYESLEKLIDYFKDGILKNENYKKFHFNWKPSNEYENINEFYNDTNNACFLLEKEEINYDHLKEQANQGKIYLFQISSKDFNEGSKGTPNLQTMYWRELFSNQNCKDGVIKLCGGASIYMRDASIKQPVVHRKNAWLINKWYKVNGQNVVIPDNTYVKFTKIAQERMNEDELTPQERQLWNSGLIQKKKATHDIMKDRRFTKKQYMLHAPLTINYKQQDSPRYFNEKVRSFLKDNPDINIIGIDRGEKNLIYITIIDQKGNILKGMQKSFNQIEEKGKEGRTIDYYSKLESVEARHDAARKNWKQIGTIRELKEGYLSQVVHEITQLMIQYNAVIVMENLNMGFKKGRMKVEKSVYQKFEKMLIDKMNYLAFKRDMQGNAIDPYEVGGVMNGYQLTDRFTSFADMGSQNGFIFYVPAAYTSVIDPVTGFVNVFQKTEFKTNDFLHRFDSISWNDKEQSFVFTFDYQNFKCNGTCYQNKWSLYADVDRIETIIKNNQVDRIEPCNPNQKLIDFFDKKGIIYRDGHNIVDDLEKYDSKTISEIIHNFKLILQLRNSMRNPDTGEIIDYIASPVMHNEERFDSRKRNPELPQDADANGAYHIALKGLMFLQKINEYADSDGNMDNRKLKITNEEWFKYMQTRKEHTYF

SEQ ID NO: 598 - protein, 1250 aa, Unknown
  source: /note="Description of Unknown: Cas12 variant sequence"
MSNKTSSITTTNKLSYTGFHNNGKQSKTLMFELKPIGRTTEHLDRKGYLADDIDRAESYKTFKEIADNFHKNLIEESLATFTFSDTLKDYFDLWLSPVRTNEDTPKLRKMEAKLRKELSSALKQHPSFAATSSGKRLIDEALYPNASDKERQCLDRFKGRSSYLDSYTEVRSFIYTDLCKHNTIAYRVVNENLKIYLENILAYEKLMQTAVNGKLETVKEMFHDLYPTFSMDISIFFTSYGFDYCLSQNAITRYNILLGGWSDDNGIHHKGLNNYINEYNQTVPRNKRLPKLNKLQKMILSEENSMSFIIDKFENDVDLANAIRYWLKNCQFDALNLLIWTLDVHYNLDEIHFKNDNQGKNISDLSQALFKNHHVIRDAWDYDYDIVNAKAKSRQKPERYAEKRDKAFKKINSFSLSYLANILSQYDNQYANFVAQFKTRISVHIQNVQQMIADKTLDMRLDPLMLLKSISSDTKLVEDIKRVLDSLKDMQRMLTPLLGEGTEPNRDAMFYSDFEPLMNYVDTLTPLYNKVRNYITKKPYSTKKTSLYFGASNFGSGFDVTKLPVSHTIIMRDKGCYYLAVIDNNKLIDKLYDHNDNDGYEYMVYKQIPSPIKYFSLKNILPQDPPDDIRQLLEDRKNGAKWSHDDETRFIDYIVNEFLPTYPPIHDKNGNPYFSWKFKNPDEYESLNEFFDDVSKQAYQTSFRFVSRDFVDDAVENGDIFFFQIYNQDFSPASHGKPSPHTLWFRALFSDVNLETKDIRLKGNATAYFRPASIFYTDEKWRKGHHYEQLKNKFKFPIIKDKRYALDKFFFHITLEINCNATVEKYFNNRVNEEIRKADRYNILAINRGERNLLYAVVMDQDGTILEQKSFNIIKSELPNKTVKETDYWKKLHAREKERDTARKSWKSIECIKDLKKGYLSYVVKTITDMMFEYNAVLVMENLDIEMKRSRQKIEKNVYAQFQNAIIQKLSMYVNKDIDLHIARTAPGGTLNPYQLTYIPASRTKTPKQNGFVFFLNPWNITEIDPTTGFVDLFQTCFRTKNEYKDFFAKFKDIRYNEAQGWFEFDTDYTYFRDKEKAGKRTRWNICSYGTRLRRFRNPDKNYAEDAMTVYPTQMLKDLFDEYNIPYAPASAKSTSISIKDDIIQIDKLDFYKKLLYILKLIVQLRNTSPSSTEQEDDYIISPVINEDTNWFYDSRDYNEESLLPCNTDANGAYSLALKCNMVIDRIKNTIPGEPVDMYISNADWLDARQ

SEQ ID NO: 599 - protein, 1328 aa, Unknown
  source: /note="Description of Unknown: Cas12 variant sequence"
MNSKTSIFDFSNIFGRDITLRFKLTPVTINSKGEVKDANGADPYRPYLSADEELQEQYELLKTAIDAYHQMYIDKKLKHILCLPLTEKGKDGVEHDTAKSKFVKSCLAYIKDYGEKDKKRQTADLRTFISRVFADDNISSLPPYKVKSDFITKTLRQWLEQPDTKVEKKEAILDLIEKNGSKLYANCQGLLEARQRLYEKDGKSTSVPYRCIDRNLPRFSKDYHLFEKILGDCSDVFDFEQLDKDFSEELKGIARLSGIRVESVREVFQPLLYLAYLNQEGIQYLNTIIGTKKEKGTSALGLNEYINQYNQKQGIKKKKDGIPMLNKLNNQILFGDEVFIETLAEHKEAIPVIKKVVSSLGKLGAFDGECHENKLYQFLLSLSSYAGNIYVNTKVVAQISSSLWGDYSILYDAVKHDKNGRLIQKSVTLGELNEKIERLKLEDNRDAFEYFRRSQVKDVVHGSSNVGVFEQLKNCYNDFVEKKILKCSFFSEDQVLVIQRLFDSILSLQRIFKVFCPSLYEVDSDGLFVAKFSDYWNVLRGFDKDYDLLRNLFKRKPYSTDKIRVHFGLSNLMDGFVDSWTDKKDKGTQYNGYILRQAHSFVDENTSKELQEFQRYNYYLVISGNVRLFREKGNALVCEKKKEKLVASDEFSGFERFDYYQSSINNFNREFKRLTGRDRKSFTDEILQNEGKKELKSTYIENLIKVAKSMKRLTALQNLVSDEKVRKYSENLDYETLSAEIGQILATGRERKYVPVSTNEMKNLLKSSKNNKGEEVRTFMFRISNKDLSYAETMQKGERKSHGAENMHTMYFRALLDTLQNTFDIGTGTVYFRKASDKRKMKYDEKNPTHRKGDELAFKNPYNKGKKKSVFGYDLIKDRRYTKDSYLFHLSITQNYQKKGNAEDLNAMVRDYIRTQEDLRVIGIDRGERNLLYATMIDGEGHILAQKSFNVIGYQGTTASGESFQVETDYHQLLNEKAEKMRSLQREWKEMDKIQDMKDGYLSVVVHELAKMVVENNAIIVMEDLNMGFMESRQSQLANVYQKFEEKLRNKLQFYVDKRKRNDEPSGLYHALQLAGTETKDNQNGFIFYIPAWNTSKIDSVTGFVNLFNLKYTNIKDAKAFFSTFEKIEKNVETGHYDFTFSYSSMARKKMAKRMDGTRDSWTISTHGSRIVREQKGNYWEYREIESLTSEFDALFEKYSIDTRCRLKEAIDKCGEAEFFKELIRLMKWTLQLRNYDDRGNDYIVSPVCYRGNEYYCSLDYDNEEGMCISKIPCQMPKDADANGAFNIARKGLMLCERLKKGEKIGVIKGTEWLQYVQNMSERYVGMV

SEQ ID NO: 600 - protein, 1434 aa, Unknown
  source: /note="Description of Unknown: Cas12 variant sequence"
MINTMEQPKKSIWDEFTNLYSLQKTLRFELKPQGKTKELVRTLFINPEEHHHKLISDDLELSKNYKKVKKLIDCMHRNIINNVLSKHQFTGEELKKLDKNSNAEDNDTETDNADKKDPFAKIRERLTKALNEESKIMFDNKLLNPKKGKNKGECELKKWMDKAEDKYFELGNNEKIDKEAVKADMERLEGFFTYFGGFNKNRENVYSSKKIATAIPFRIIHDNFPIFKKNIENYKKITEKHPELAKLLNEKGANEIFQLEHFNKCLTQDGIDVYNNEKLGIIAKEQGKEQDKGINQLINEYAQKKNKEIKENAKGGEKPKKIKIAVFDKLKKQILSISKTKSFQFEVFEDTSDIINGINKRYTFLTEAKEGMSIVDEIKKIIGSVGDEKYSLDEIYLKEKFISTLSKKLFNYSRYIEVALEKWYDDRYDDKINKSGTDKRKFISAKQFSITSIQDAINYYLEKYEKDEELSKKYTGKNIIVDYFKNPTITIEHKQKEEVISEEKDLFKELEVRRNVIQHILNGDYKKDLKEEKQQDGDSEKVKAFLDALLEFNYILNPFIIKDKNLRKEQEKDEEFYNEIKKLQESIFEAEILDLYNQTRNYITKKPYKLDKFKLTFGSGYFLSGWSNDMEEREGSILIKYNEDRSKNYYLIIMAKPLTDDDKKQLFSDNGTHSKICIYEFQKMDMKNFPRMFINSKGSNPAPAIEKYNLPIKTIWADYQKYKNLNQKGKDKFLEENPDFRHNLIGYFKICAEKHESLAPFKHQFSSIWKPTKEYENLAQFYKDTLEACYNLKFENVNFDNISQLVSSGKLHLFKIHNKDFNPGSTGKKNLHTLYWEMLFDEKNLQDVIFKLSGGAELFYREASILKNKIIHKIGEKVLKKFFKLPDGKLEPVPAESIKNLSAYFRKELPEHELTEIDRKYIDNYSIIGKKDDKLGIMKDERFTVDKIQFHCPITINFKSKNKNFINDDVLEYLHKRDDVHIIGLDRGERHLIYLTMINKDGKIVDNMQFSLNELQRRYKINGNEEIQKINYQKLLDTREVSRTEARRNWQTIENIKNLKEGYLSLIVHQLAKLMIEKNAIVVMENLNYGFKDSRARVEKQIYQKFESILIKKLQYLVMDKNNLYDSGGVLSAYQLTNQEVPAYKYISKQNGFLFYVPPDYTSKIDPETGFINLLDTRYYSRKNAVALLNKFDKIYYDRDNKYFRFDFDYNSTDSNGNKNFDKLRVDISELTRTKWSVCSHPAKRSITVQINNKWVRQPINDVTDKLIKLFEDKQIGYESGKCLKDEILKVEDAKFFEDLLRYLSVLLALRHTYTENGVEYDLIISSVEKAPGSNEFFVSGKDNNLPANADANGAYNIARKGLWLLRKLDEIDNQELAIKKFNELKHAKEIKKNGEESKEDKGDRKRKKKWVSQWCPNKEWLAFAQSMQDVSEK

SEQ ID NO: 601 - protein, 1263 aa, Unknown
  source: /note="Description of Unknown: Cas12 variant sequence"
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 602 - protein, 1283 aa, Unknown
  source: /note="Description of Unknown: Cas12 variant sequence"
MSNLNTFISPEFTGKIKMTKSLKVSMIPIGETEHWIAKHKVFEKDRELFDKNLKARPILDEFIKYTVSRALPNLLFDFEAYYLVKKDRTKARAFEKELAKTVTDLILKEMDELKSASLIDSADFVKTTLKKFAGTHDIPGLSRIEAIESLEAASKLTALNGKFNTSRIAIINTLIPKRIIENFDIYLSNMEKIRNVYESGEFGFLFERYPDTLLFMEPANYRTVCSPEAIEDYNRFISGYGDSTESWIKGFNQELSEASNSSKSSNGGVRRYSLIKPLHKQHLFETKKFFTFASISSDDDVRELINSVKGSTEDACLNALAFFSSSDPKTLFVKGSYLHTLSAFLYGSANSYILPERIKEGEKARLTAEYDSVAKKTKAVTTRYNVAMNNISKKINEKIFSLADIDAYCCDISKRRSVREILLGIMQEMYAAVYGENGKWSNIEAEAVLDSKTKIWKAKNGAVAKAVNDYLTAILEIRKFIRPFALRMEELEELGLDTSSALDAGEITNTLFEAVRAQKLVHAYLTRNDADIALSTQVYFGGTQKAAASWWNYETGDIQNRQIALAKKDGMYYFIGTFDERGSYSIEPASPGEDYYEMLDVKKGQDANKQIKKVLFSNKAIREHFADSSNDYVITTKVNSPITVRREIFDKYQAGEFKLTSQKIRKGDLVGEKEMTYYREYMDLLFQMAKGYTEYSRFNMDTLLPIEEYDTENDLLDDVNTNTIDYRWVRISAACIDDGVRNGDIFVFRAQTSSMYGKRENKKGYTGLFLELVSDENLLVTRGMSLNSAMSIYYRAKVHDAITVHKKGDVLVNKFTNARERIPENSYKAICAFYNSGKSIEELTIEDRDWLAKATTRICSGEIIKDRRYTKNQYSISISYNINRSVNNRKRVDLATIVDDTASAGRIISVTRGTKDLVYYTVIDDGGSVIEARSLNVINGINYAKMLAQISEERHDSNANFDIPKRVETIKEAYCAFAVHEIISAALKHNALIVVELISDAIKDKYSLLDNQVFLKFENVLKNCLMSVKVKGARGMEPGSISNPLQLCNADDKSFRNGILYQIPSSYINICPVTGYADIIDYYNIVSAGDIRNFFVRFENIVYNKEKARFEFSFDLKNIPIKLEKCPDRTKWTVLGRGEITTYDPLTKSNHYVFDAAQMLAETVSKEGLDPCANIVEHIDELSAATLKKMFNTFRNIAKGIVSECDEVPVSYYKSPVIDEADIKNKSLDNKSISEIKCYNLDEKARYYLALAKSSSDGENKNRYVSSTAIEWLNYIQEKRTHE

SEQ ID NO: 603 - DNA, 55 bp, Unknown
  source: /note="Description of Unknown: non target strand sequence"
gcccgcgggattttttcctgcagcagaaaatcaaagacaatgaatatttcggcgc

SEQ ID NO: 604 - DNA, 55 bp, Unknown
  source: /note="Description of Unknown: target strand sequence"
gcgccgaaatattcattgtctttgattttctgctgcaggaaaaaatcccgcgggc

SEQ ID NO: 605 - DNA, 55 bp, Unknown
  source: /note="Description of Unknown: non target strand sequence"
gcccgcgggattttgtcctgcagcagaaaatcaaagacaatgaatatttcggcgc

SEQ ID NO: 606 - DNA, 55 bp, Unknown
  source: /note="Description of Unknown: target strand sequence"
gcgccgaaatattcattgtctttgattttctgctgcaggacaaaatcccgcgggc

SEQ ID NO: 607 - DNA, 55 bp, Unknown
  source: /note="Description of Unknown: non target strand sequence"
gcccgcgggattttctcctgcagcagaaaatcaaagacaatgaatatttcggcgc

SEQ ID NO: 608 - DNA, 55 bp, Unknown
  source: /note="Description of Unknown: target strand sequence"
gcgccgaaatattcattgtctttgattttctgctgcaggagaaaatcccgcgggc

SEQ ID NO: 609 - DNA, 55 bp, Unknown
  source: /note="Description of Unknown: non target strand sequence"
gcccgcgggattttatcctgcagcagaaaatcaaagacaatgaatatttcggcgc

SEQ ID NO: 610 - DNA, 55 bp, Unknown
  source: /note="Description of Unknown: target strand sequence"
gcgccgaaatattcattgtctttgattttctgctgcaggataaaatcccgcgggc

SEQ ID NO: 611 - DNA, 55 bp, Unknown
  source: /note="Description of Unknown: non target strand sequence"
gcccgcgggatttgatcctgcagcagaaaatcaaagacaatgaatatttcggcgc

SEQ ID NO: 612 - DNA, 55 bp, Unknown
  source: /note="Description of Unknown: target strand sequence"
gcgccgaaatattcattgtctttgattttctgctgcaggatcaaatcccgcgggc

SEQ ID NO: 613 - DNA, 55 bp, Unknown
  source: /note="Description of Unknown: non target strand sequence"
gcccgcgggatttcatcctgcagcagaaaatcaaagacaatgaatatttcggcgc

SEQ ID NO: 614 - DNA, 55 bp, Unknown
  source: /note="Description of Unknown: target strand sequence"
gcgccgaaatattcattgtctttgattttctgctgcaggatgaaatcccgcgggc

SEQ ID NO: 615 - DNA, 55 bp, Unknown
  source: /note="Description of Unknown: non target strand sequence"
gcccgcgggatttaatcctgcagcagaaaatcaaagacaatgaatatttcggcgc

SEQ ID NO: 616 - DNA, 55 bp, Unknown
  source: /note="Description of Unknown: target strand sequence"
gcgccgaaatattcattgtctttgattttctgctgcaggattaaatcccgcgggc

SEQ ID NO: 617 - DNA, 55 bp, Unknown
  source: /note="Description of Unknown: non target strand sequence"
gcccgcgggattgtatcctgcagcagaaaatcaaagacaatgaatatttcggcgc

SEQ ID NO: 618 - DNA, 55 bp, Unknown
  source: /note="Description of Unknown: target strand sequence"
gcgccgaaatattcattgtctttgattttctgctgcaggatacaatcccgcgggc

SEQ ID NO: 619 - DNA, 55 bp, Unknown
  source: /note="Description of Unknown: non target strand sequence"
gcccgcgggattctatcctgcagcagaaaatcaaagacaatgaatatttcggcgc

SEQ ID NO: 620 - DNA, 55 bp, Unknown
  source: /note="Description of Unknown: target strand sequence"
gcgccgaaatattcattgtctttgattttctgctgcaggatagaatcccgcgggc

SEQ ID NO: 621 - DNA, 55 bp, Unknown
  source: /note="Description of Unknown: non target strand sequence"
gcccgcgggattatatcctgcagcagaaaatcaaagacaatgaatatttcggcgc

SEQ ID NO: 622 - DNA, 55 bp, Unknown
  source: /note="Description of Unknown: target strand sequence"
gcgccgaaatattcattgtctttgattttctgctgcaggatataatcccgcgggc

SEQ ID NO: 623 - DNA, 55 bp, Unknown
  source: /note="Description of Unknown: non target strand sequence"
gcccgcgggatgttatcctgcagcagaaaatcaaagacaatgaatatttcggcgc

SEQ ID NO: 624 - DNA, 55 bp, Unknown
  source: /note="Description of Unknown: target strand sequence"
gcgccgaaatattcattgtctttgattttctgctgcaggataacatcccgcgggc

SEQ ID NO: 625 - DNA, 55 bp, Unknown
  source: /note="Description of Unknown: non target strand sequence"
gcccgcgggatcttatcctgcagcagaaaatcaaagacaatgaatatttcggcgc

SEQ ID NO: 626 - DNA, 55 bp, Unknown
  source: /note="Description of Unknown: target strand sequence"
gcgccgaaatattcattgtctttgattttctgctgcaggataagatcccgcgggc

SEQ ID NO: 627 - DNA, 55 bp, Unknown
  source: /note="Description of Unknown: non target strand sequence"
gcccgcgggatattatcctgcagcagaaaatcaaagacaatgaatatttcggcgc

SEQ ID NO: 628 - DNA, 55 bp, Unknown
  source: /note="Description of Unknown: target strand sequence"
gcgccgaaatattcattgtctttgattttctgctgcaggataatatcccgcgggc

SEQ ID NO: 629 - DNA, 55 bp, Unknown
  source: /note="Description of Unknown: non target strand sequence"
gcccgcgggattttaccctgcagcagaaaatcaaagacaatgaatatttcggcgc

SEQ ID NO: 630 - DNA, 55 bp, Unknown
  source: /note="Description of Unknown: target strand sequence"
gcgccgaaatattcattgtctttgattttctgctgcagggtaaaatcccgcgggc

SEQ ID NO: 631 - DNA, 55 bp, Unknown
  source: /note="Description of Unknown: non target strand sequence"
gcccgcgggattttatcctacagcagaaaatcaaagacaatgaatatttcggcgc

SEQ ID NO: 632 - DNA, 55 bp, Unknown
  source: /note="Description of Unknown: target strand sequence"
gcgccgaaatattcattgtctttgattttctgctgtaggataaaatcccgcgggc

SEQ ID NO: 633 - DNA, 55 bp, Unknown
  source: /note="Description of Unknown: non target strand sequence"
gcccgcgggattttatcctgcagcggaaaatcaaagacaatgaatatttcggcgc

SEQ ID NO: 634 - DNA, 55 bp, Unknown
  source: /note="Description of Unknown: target strand sequence"
gcgccgaaatattcattgtctttgattttccgctgcaggataaaatcccgcgggc

SEQ ID NO: 635 - DNA, 55 bp, Unknown
  source: /note="Description of Unknown: non target strand sequence"
gcccgcgggattttatcctgcagcagaaagtcaaagacaatgaatatttcggcgc

SEQ ID NO: 636 - DNA, 55 bp, Unknown
  source: /note="Description of Unknown: target strand sequence"
gcgccgaaatattcattgtctttgactttctgctgcaggataaaatcccgcgggc

SEQ ID NO: 637 - DNA, 55 bp, Unknown
  source: /note="Description of Unknown: non target strand sequence"
gcccgcgggattttactctgcagcagaaaatcaaagacaatgaatatttcggcgc

SEQ ID NO: 638 - DNA, 55 bp, Unknown
  source: /note="Description of Unknown: target strand sequence"
gcgccgaaatattcattgtctttgattttctgctgcagagtaaaatcccgcgggc

SEQ ID NO: 639 - DNA, 55 bp, Unknown
  source: /note="Description of Unknown: non target strand sequence"
gcccgcgggattttatctcgcagcagaaaatcaaagacaatgaatatttcggcgc

SEQ ID NO: 640 - DNA, 55 bp, Unknown
  source: /note="Description of Unknown: target strand sequence"
gcgccgaaatattcattgtctttgattttctgctgcgagataaaatcccgcgggc

SEQ ID NO: 641 - DNA, 55 bp, Unknown
  source: /note="Description of Unknown: non target strand sequence"
gcccgcgggattttatcctatagcagaaaatcaaagacaatgaatatttcggcgc

SEQ ID NO: 642 - DNA, 55 bp, Unknown
  source: /note="Description of Unknown: target strand sequence"
gcgccgaaatattcattgtctttgattttctgctataggataaaatcccgcgggc

SEQ ID NO: 643 - DNA, 55 bp, Unknown
  source: /note="Description of Unknown: non target strand sequence"
gcccgcgggattttatcctgcgacagaaaatcaaagacaatgaatatttcggcgc

SEQ ID NO: 644 - DNA, 55 bp, Unknown
  source: /note="Description of Unknown: target strand sequence"
gcgccgaaatattcattgtctttgattttctgtcgcaggataaaatcccgcgggc

SEQ ID NO: 645 - DNA, 55 bp, Unknown
  source: /note="Description of Unknown: non target strand sequence"
gcccgcgggattttatcctgcagtggaaaatcaaagacaatgaatatttcggcgc

SEQ ID NO: 646 - DNA, 55 bp, Unknown
  source: /note="Description of Unknown: target strand sequence"
gcgccgaaatattcattgtctttgattttccactgcaggataaaatcccgcgggc

SEQ ID NO: 647 - DNA, 55 bp, Unknown
  source: /note="Description of Unknown: non target strand sequence"
gcccgcgggattttatcctgcagcaagaaatcaaagacaatgaatatttcggcgc

SEQ ID NO: 648 - DNA, 55 bp, Unknown
  source: /note="Description of Unknown: target strand sequence"
gcgccgaaatattcattgtctttgatttcttgctgcaggataaaatcccgcgggc

SEQ ID NO: 649 - DNA, 55 bp, Unknown
  source: /note="Description of Unknown: non target strand sequence"
gcccgcgggattttatcctgcagcagaggatcaaagacaatgaatatttcggcgc

SEQ ID NO: 650 - DNA, 55 bp, Unknown
  source: /note="Description of Unknown: target strand sequence"
gcgccgaaatattcattgtctttgatcctctgctgcaggataaaatcccgcgggc

SEQ ID NO: 651 - DNA, 55 bp, Unknown
  source: /note="Description of Unknown: non target strand sequence"
gcccgcgggattttatcctgcagcagaaagccaaagacaatgaatatttcggcgc

SEQ ID NO: 652 - DNA, 55 bp, Unknown
  source: /note="Description of Unknown: target strand sequence"
gcgccgaaatattcattgtctttggctttctgctgcaggataaaatcccgcgggc

SEQ ID NO: 653 - DNA, 55 bp, Unknown
  source: /note="Description of Unknown: non target strand sequence"
gcccgcgggattttatcctgcagcagaaaattgaagacaatgaatatttcggcgc

SEQ ID NO: 654 - DNA, 55 bp, Unknown
  source: /note="Description of Unknown: target strand sequence"
gcgccgaaatattcattgtcttcaattttctgctgcaggataaaatcccgcgggc

SEQ ID NO: 655 - DNA, 55 bp, Unknown
  source: /note="Description of Unknown: non target strand sequence"
gcccgcgggattttatcctgcagcagaaaatcagggacaatgaatatttcggcgc

SEQ ID NO: 656 - DNA, 55 bp, Unknown
  source: /note="Description of Unknown: target strand sequence"
gcgccgaaatattcattgtccctgattttctgctgcaggataaaatcccgcgggc

SEQ ID NO: 657 - DNA, 55 bp, Unknown
  source: /note="Description of Unknown: non target strand sequence"
gcccgcgggattttatcctgcagcagaaaatcaaaagcaatgaatatttcggcgc

SEQ ID NO: 658 - DNA, 55 bp, Unknown
  source: /note="Description of Unknown: target strand sequence"
gcgccgaaatattcattgcttttgattttctgctgcaggataaaatcccgcgggc

SEQ ID NO: 659 - DNA, 54 bp, Unknown
  source: /note="Description of Unknown: non target strand sequence"
ggccagtttcatttgagcattaaatgtcaagttctgcacgctatcatcatcagg

SEQ ID NO: 660 - DNA, 54 bp, Unknown
  source: /note="Description of Unknown: target strand sequence"
cctgatgatgatagcgtgcagaacttgacatttaatgctcaaatgaaactggcc

SEQ ID NO: 661 - DNA, 20 bp, Artificial Sequence
  source: /note="Description of Artificial Sequence: Synthetic oligonucleotide"
ttaagagaagcaacatctcc

SEQ ID NO: 662 - DNA, 20 bp, Artificial Sequence
  source: /note="Description of Artificial Sequence: Synthetic oligonucleotide"
gctatcaaggaatcatctcc

SEQ ID NO: 663 - DNA, 20 bp, Artificial Sequence
  source: /note="Description of Artificial Sequence: Synthetic oligonucleotide"
atcaaggaagcaacatctcc

SEQ ID NO: 664 - DNA, 20 bp, Artificial Sequence
  source: /note="Description of Artificial Sequence: Synthetic oligonucleotide"
cccgtcgctatcaaggatcc

SEQ ID NO: 665 - DNA, 20 bp, Artificial Sequence
  source: /note="Description of Artificial Sequence: Synthetic oligonucleotide"
gtcgctatcaaaacatctcc

SEQ ID NO: 666 - DNA, 20 bp, Artificial Sequence
  source: /note="Description of Artificial Sequence: Synthetic oligonucleotide"
gtcgctatcaagacatctcc

SEQ ID NO: 667 - DNA, 20 bp, Artificial Sequence
  source: /note="Description of Artificial Sequence: Synthetic oligonucleotide"
cccgtcgctatcaaggaacc

SEQ ID NO: 668 - DNA, 20 bp, Artificial Sequence
  source: /note="Description of Artificial Sequence: Synthetic oligonucleotide"
cccgtcgctatcaaggctcc

SEQ ID NO: 669 - DNA, 20 bp, Artificial Sequence
  source: /note="Description of Artificial Sequence: Synthetic oligonucleotide"
gtcgctatcaaggaatctcc

SEQ ID NO: 670 - DNA, 20 bp, Artificial Sequence
  source: /note="Description of Artificial Sequence: Synthetic oligonucleotide"
cccgtcgctatcaaggaatc

SEQ ID NO: 671 - DNA, 20 bp, Artificial Sequence
  source: /note="Description of Artificial Sequence: Synthetic oligonucleotide"
atcaaggaaccaacatctcc

SEQ ID NO: 672 - DNA, 20 bp, Artificial Sequence
  source: /note="Description of Artificial Sequence: Synthetic oligonucleotide"
gctatcaaggaaccatctcc

SEQ ID NO: 673 - DNA, 20 bp, Artificial Sequence
  source: /note="Description of Artificial Sequence: Synthetic oligonucleotide"
cccgtcgctatcaaggttcc

SEQ ID NO: 674 - DNA, 20 bp, Artificial Sequence
  source: /note="Description of Artificial Sequence: Synthetic oligonucleotide"
cccgtcgctatcaaaattcc

SEQ ID NO: 675 - DNA, 20 bp, Artificial Sequence
  source: /note="Description of Artificial Sequence: Synthetic oligonucleotide"
gtcgctatcaaggtatctcc

SEQ ID NO: 676 - DNA, 20 bp, Artificial Sequence
  source: /note="Description of Artificial Sequence: Synthetic oligonucleotide"
cccgtcgctatcaaggaaca

SEQ ID NO: 677 - DNA, 20 bp, Artificial Sequence
  source: /note="Description of Artificial Sequence: Synthetic oligonucleotide"
gtcgctatcaaggaacaacc

SEQ ID NO: 678 - DNA, 20 bp, Artificial Sequence
  source: /note="Description of Artificial Sequence: Synthetic oligonucleotide"
gctatcaaggttgcttctcc

SEQ ID NO: 679 - DNA, 20 bp, Artificial Sequence
  source: /note="Description of Artificial Sequence: Synthetic oligonucleotide"
gctatcaaggagcaatctcc

SEQ ID NO: 680 - DNA, 20 bp, Artificial Sequence
  source: /note="Description of Artificial Sequence: Synthetic oligonucleotide"
atcaaggagccaacatctcc

SEQ ID NO: 681 - DNA, 20 bp, Artificial Sequence
  source: /note="Description of Artificial Sequence: Synthetic oligonucleotide"
gtcgctatcaaggcatctcc

SEQ ID NO: 682 - DNA, 20 bp, Artificial Sequence
  source: /note="Description of Artificial Sequence: Synthetic oligonucleotide"
cccgtcgctatcaagtctcc

SEQ ID NO: 683 - DNA, 20 bp, Artificial Sequence
  source: /note="Description of Artificial Sequence: Synthetic oligonucleotide"
atcaaaattccaacatctcc

SEQ ID NO: 684 - DNA, 20 bp, Artificial Sequence
  source: /note="Description of Artificial Sequence: Synthetic oligonucleotide"
gtcgctatcaaaatatctcc

SEQ ID NO: 685 - DNA, 20 bp, Artificial Sequence
  source: /note="Description of Artificial Sequence: Synthetic oligonucleotide"
gctatcaaaattccatctcc

SEQ ID NO: 686 - DNA, 20 bp, Artificial Sequence
  source: /note="Description of Artificial Sequence: Synthetic oligonucleotide"
cccgtcgctatcaaggtctc

SEQ ID NO: 687 - DNA, 20 bp, Artificial Sequence
  source: /note="Description of Artificial Sequence: Synthetic oligonucleotide"
gtcgctatcgcaacatctcc

SEQ ID NO: 688 - DNA, 20 bp, Artificial Sequence
  source: /note="Description of Artificial Sequence: Synthetic oligonucleotide"
ggagatgttgcttctcttaa

SEQ ID NO: 689 - DNA, 20 bp, Artificial Sequence
  source: /note="Description of Artificial Sequence: Synthetic oligonucleotide"
ggagatgattccttgatagc

SEQ ID NO: 690 - DNA, 20 bp, Artificial Sequence
  source: /note="Description of Artificial Sequence: Synthetic oligonucleotide"
ggagatgttgcttccttgat

SEQ ID NO: 691 - DNA, 20 bp, Artificial Sequence
  source: /note="Description of Artificial Sequence: Synthetic oligonucleotide"
ggatccttgatagcgacggg

SEQ ID NO: 692 - DNA, 20 bp, Artificial Sequence
  source: /note="Description of Artificial Sequence: Synthetic oligonucleotide"
ggagatgttttgatagcgac

SEQ ID NO: 693 - DNA, 20 bp, Artificial Sequence
  source: /note="Description of Artificial Sequence: Synthetic oligonucleotide"
ggagatgtcttgatagcgac

SEQ ID NO: 694 - DNA, 20 bp, Artificial Sequence
  source: /note="Description of Artificial Sequence: Synthetic oligonucleotide"
ggttccttgatagcgacggg

SEQ ID NO: 695 - DNA, 20 bp, Artificial Sequence
  source: /note="Description of Artificial Sequence: Synthetic oligonucleotide"
ggagccttgatagcgacggg

SEQ ID NO: 696 - DNA, 20 bp, Artificial Sequence
  source: /note="Description of Artificial Sequence: Synthetic oligonucleotide"
ggagattccttgatagcgac

SEQ ID NO: 697 - DNA, 20 bp, Artificial Sequence
  source: /note="Description of Artificial Sequence: Synthetic oligonucleotide"
gattccttgatagcgacggg

SEQ ID NO: 698 - DNA, 20 bp, Artificial Sequence
  source: /note="Description of Artificial Sequence: Synthetic oligonucleotide"
ggagatgttggttccttgat

SEQ ID NO: 699 - DNA, 20 bp, Artificial Sequence
  source: /note="Description of Artificial Sequence: Synthetic oligonucleotide"
ggagatggttccttgatagc

SEQ ID NO: 700 - DNA, 20 bp, Artificial Sequence
  source: /note="Description of Artificial Sequence: Synthetic oligonucleotide"
ggaaccttgatagcgacggg

SEQ ID NO: 701 - DNA, 20 bp, Artificial Sequence
  source: /note="Description of Artificial Sequence: Synthetic oligonucleotide"
ggaattttgatagcgacggg

SEQ ID NO: 702 - DNA, 20 bp, Artificial Sequence
  source: /note="Description of Artificial Sequence: Synthetic oligonucleotide"
ggagataccttgatagcgac

SEQ ID NO: 703 - DNA, 20 bp, Artificial Sequence
  source: /note="Description of Artificial Sequence: Synthetic oligonucleotide"
tgttccttgatagcgacggg

SEQ ID NO: 704 - DNA, 20 bp, Artificial Sequence
  source: /note="Description of Artificial Sequence: Synthetic oligonucleotide"
ggttgttccttgatagcgac

SEQ ID NO: 705 - DNA, 20 bp, Artificial Sequence
  source: /note="Description of Artificial Sequence: Synthetic oligonucleotide"
ggagaagcaaccttgatagc

SEQ ID NO: 706 - DNA, 20 bp, Artificial Sequence
  source: /note="Description of Artificial Sequence: Synthetic oligonucleotide"
ggagattgctccttgatagc

SEQ ID NO: 707 - DNA, 20 bp, Artificial Sequence
  source: /note="Description of Artificial Sequence: Synthetic oligonucleotide"
ggagatgttggctccttgat

SEQ ID NO: 708 - DNA, 20 bp, Artificial Sequence
  source: /note="Description of Artificial Sequence: Synthetic oligonucleotide"
ggagatgccttgatagcgac

SEQ ID NO: 709 - DNA, 20 bp, Artificial Sequence
  source: /note="Description of Artificial Sequence: Synthetic oligonucleotide"
ggagacttgatagcgacggg

SEQ ID NO: 710 - DNA, 20 bp, Artificial Sequence
  source: /note="Description of Artificial Sequence: Synthetic oligonucleotide"
ggagatgttggaattttgat

SEQ ID NO: 711 - DNA, 20 bp, Artificial Sequence
  source: /note="Description of Artificial Sequence: Synthetic oligonucleotide"
ggagatattttgatagcgac

SEQ ID NO: 712 - DNA, 20 bp, Artificial Sequence
  source: /note="Description of Artificial Sequence: Synthetic oligonucleotide"
ggagatggaattttgatagc

SEQ ID NO: 713 - DNA, 20 bp, Artificial Sequence
  source: /note="Description of Artificial Sequence: Synthetic oligonucleotide"
gagaccttgatagcgacggg

SEQ ID NO: 714 - DNA, 20 bp, Artificial Sequence
  source: /note="Description of Artificial Sequence: Synthetic oligonucleotide"
ggagatgttgcgatagcgac

SEQ ID NO: 715 - DNA, 20 bp, Artificial Sequence
  source: /note="Description of Artificial Sequence: Synthetic oligonucleotide"
ggctggccaaactgctgggt

SEQ ID NO: 716 - DNA, 20 bp, Artificial Sequence
  source: /note="Description of Artificial Sequence: Synthetic oligonucleotide"
ggcgggccaaactgctgggt

SEQ ID NO: 717 - DNA, 20 bp, Artificial Sequence
  source: /note="Description of Artificial Sequence: Synthetic oligonucleotide"
ggcgtgccaaactgctgggt

SEQ ID NO: 718 - DNA, 41 bp, Artificial Sequence
  source: /note="Description of Artificial Sequence: Synthetic oligonucleotide"
taatttctactaagtgtagatggagatgttgcttctcttaa

SEQ ID NO: 719 - DNA, 41 bp, Artificial Sequence
  source: /note="Description of Artificial Sequence: Synthetic oligonucleotide"
taatttctactaagtgtagatggagatgattccttgatagc

SEQ ID NO: 720 - DNA, 41 bp, Artificial Sequence
  source: /note="Description of Artificial Sequence: Synthetic oligonucleotide"
taatttctactaagtgtagatggagatgttgcttccttgat

SEQ ID NO: 721 - DNA, 41 bp, Artificial Sequence
  source: /note="Description of Artificial Sequence: Synthetic oligonucleotide"
taatttctactaagtgtagatggatccttgatagcgacggg

SEQ ID NO: 722 - DNA, 41 bp, Artificial Sequence
  source: /note="Description of Artificial Sequence: Synthetic oligonucleotide"
taatttctactaagtgtagatggagatgttttgatagcgac

SEQ ID NO: 723 - DNA, 41 bp, Artificial Sequence
  source: /note="Description of Artificial Sequence: Synthetic oligonucleotide"
taatttctactaagtgtagatggagatgtcttgatagcgac

SEQ ID NO: 724 - DNA, 41 bp, Artificial Sequence
  source: /note="Description of Artificial Sequence: Synthetic oligonucleotide"
taatttctactaagtgtagatggttccttgatagcgacggg

SEQ ID NO: 725 - DNA, 41 bp, Artificial Sequence
  source: /note="Description of Artificial Sequence: Synthetic oligonucleotide"
taatttctactaagtgtagatggagccttgatagcgacggg

SEQ ID NO: 726 - DNA, 41 bp, Artificial Sequence
  source: /note="Description of Artificial Sequence: Synthetic oligonucleotide"
taatttctactaagtgtagatggagattccttgatagcgac

SEQ ID NO: 727 - DNA, 41 bp, Artificial Sequence
  source: /note="Description of Artificial Sequence: Synthetic oligonucleotide"
taatttctactaagtgtagatgattccttgatagcgacggg

SEQ ID NO: 728 - DNA, 41 bp, Artificial Sequence
  source: /note="Description of Artificial Sequence: Synthetic oligonucleotide"
taatttctactaagtgtagatggagatgttggttccttgat

SEQ ID NO: 729 - DNA, 41 bp, Artificial Sequence
  source: /note="Description of Artificial Sequence: Synthetic oligonucleotide"
taatttctactaagtgtagatggagatggttccttgatagc

SEQ ID NO: 730 - DNA, 41 bp, Artificial Sequence
  source: /note="Description of Artificial Sequence: Synthetic oligonucleotide"
taatttctactaagtgtagatggaaccttgatagcgacggg

SEQ ID NO: 731 - DNA, 41 bp, Artificial Sequence
  source: /note="Description of Artificial Sequence: Synthetic oligonucleotide"
taatttctactaagtgtagatggaattttgatagcgacggg

SEQ ID NO: 732 - DNA, 41 bp, Artificial Sequence
  source: /note="Description of Artificial Sequence: Synthetic oligonucleotide"
taatttctactaagtgtagatggagataccttgatagcgac

SEQ ID NO: 733 - DNA, 41 bp, Artificial Sequence
  source: /note="Description of Artificial Sequence: Synthetic oligonucleotide"
taatttctactaagtgtagattgttccttgatagcgacggg

SEQ ID NO: 734 - DNA, 41 bp, Artificial Sequence
  source: /note="Description of Artificial Sequence: Synthetic oligonucleotide"
taatttctactaagtgtagatggttgttccttgatagcgac

SEQ ID NO: 735 - DNA, 41 bp, Artificial Sequence
  source: /note="Description of Artificial Sequence: Synthetic oligonucleotide"
taatttctactaagtgtagatggagaagcaaccttgatagc

SEQ ID NO: 736 - DNA, 41 bp, Artificial Sequence
  source: /note="Description of Artificial Sequence: Synthetic oligonucleotide"
taatttctactaagtgtagatggagattgctccttgatagc

SEQ ID NO: 737 - DNA, 41 bp, Artificial Sequence
  source: /note="Description of Artificial Sequence: Synthetic oligonucleotide"
taatttctactaagtgtagatggagatgttggctccttgat

SEQ ID NO: 738 - DNA, 41 bp, Artificial Sequence
  source: /note="Description of Artificial Sequence: Synthetic oligonucleotide"
taatttctactaagtgtagatggagatgccttgatagcgac

SEQ ID NO: 739 - DNA, 41 bp, Artificial Sequence
  source: /note="Description of Artificial Sequence: Synthetic oligonucleotide"
taatttctactaagtgtagatggagacttgatagcgacggg

SEQ ID NO: 740 - DNA, 41 bp, Artificial Sequence
  source: /note="Description of Artificial Sequence: Synthetic oligonucleotide"
taatttctactaagtgtagatggagatgttggaattttgat

SEQ ID NO: 741 - DNA, 41 bp, Artificial Sequence
  source: /note="Description of Artificial Sequence: Synthetic oligonucleotide"
taatttctactaagtgtagatggagatattttgatagcgac

SEQ ID NO: 742 - DNA, 41 bp, Artificial Sequence
  source: /note="Description of Artificial Sequence: Synthetic oligonucleotide"
taatttctactaagtgtagatggagatggaattttgatagc

SEQ ID NO: 743 - DNA, 41 bp, Artificial Sequence
  source: /note="Description of Artificial Sequence: Synthetic oligonucleotide"
taatttctactaagtgtagatgagaccttgatagcgacggg

SEQ ID NO: 744 - DNA, 41 bp, Artificial Sequence
  source: /note="Description of Artificial Sequence: Synthetic oligonucleotide"
taatttctactaagtgtagatggagatgttgcgatagcgac

SEQ ID NO: 745 - DNA, 41 bp, Artificial Sequence
  source: /note="Description of Artificial Sequence: Synthetic oligonucleotide"
taatttctactaagtgtagatggctggccaaactgctgggt

SEQ ID NO: 746 - DNA, 41 bp, Artificial Sequence
  source: /note="Description of Artificial Sequence: Synthetic oligonucleotide"
taatttctactaagtgtagatggcgggccaaactgctgggt

SEQ ID NO: 747 - DNA, 41 bp, Artificial Sequence
  source: /note="Description of Artificial Sequence: Synthetic oligonucleotide"
taatttctactaagtgtagatggcgtgccaaactgctgggt

SEQ ID NO: 748 - RNA, 40 nt, Unknown
  source: /note="Description of Unknown: target sequence"
uggacaaagcgucuacgcugcaguccucgcucacugggca

SEQ ID NO: 749 - DNA, 48 bp, Unknown
  source: /note="Description of Unknown: target sequence"
ttttggacaaagcgtctacgctgcagtcctcgctcactgggcacggtg

SEQ ID NO: 750 - DNA, 34 bp, Homo sapiens
ccagtttcatttgagcattaagtgtcaagttctg

SEQ ID NO: 751 - DNA, 34 bp, Homo sapiens
cagaacttgacacttaatgctcaaatgaaactgg

SEQ ID NO: 752 - DNA, 55 bp, Homo sapiens
cacactcacagttttcacttcagtgtatgcctgcagcccgtactcgcccaactcc

SEQ ID NO: 753 - DNA, 55 bp, Homo sapiens
ggagttgggcgagtacgggctgcaggcatacactgaagtgaaaactgtgagtgtg

SEQ ID NO: 754 - DNA, 372 bp, Artificial Sequence
  source: /note="Description of Artificial Sequence: Synthetic polynucleotide"
agcgaaagcaggtagatattgaaagatgagtcttctaaccgaggtcgaaacgtacgttctctctatcgtcccgtcaggccccctcaaagccgagatcgcgcagagacttgaagatgtctttgcagggaaaaacacagatcttgaggctctcatggaatggctaaagacaagaccaatcctgtcacctctgactaaggggattttaggatttgtgttcacgctcaccgtgcccagtgagcgaggactgcagcgtagacgctttgtccaaaatgccctcaatgggaatggggacccaaacaacatggacagagcagttaaactgtacaggaagcttaaaagggaaataacgttccatggggccaaagaagtggc

SEQ ID NO: 755 - DNA, 372 bp, Artificial Sequence
  source: /note="Description of Artificial Sequence: Synthetic polynucleotide"
gccacttctttggccccatggaacgttatttcccttttaagcttcctgtacagtttaactgctctgtccatgttgtttgggtccccattcccattgagggcattttggacaaagcgtctacgctgcagtcctcgctcactgggcacggtgagcgtgaacacaaatcctaaaatccccttagtcagaggtgacaggattggtcttgtctttagccattccatgagagcctcaagatctgtgtttttccctgcaaagacatcttcaagtctctgcgcgatctcggctttgagggggcctgacgggacgatagagagaacgtacgtttcgacctcggttagaagactcatctttcaatatctacctgctttcgct

SEQ ID NO: 756 - DNA, 94 bp, Homo sapiens
gcctcacctccaccgtgcagctcatcatgcagctcatgcccttcggctgcctcctggactatgtccgggaacacaaagacaatattggctccca

SEQ ID NO: 757 - DNA, 94 bp, Homo sapiens
tgggagccaatattgtctttgtgttcccggacatagtccaggaggcagccgaagggcatgagctgcatgatgagctgcacggtggaggtgaggc

SEQ ID NO: 758 - protein, 32 aa, Homo sapiens
CLTSTVQLIMQLMPFGCLLDYVREHKDNIGSQ

SEQ ID NO: 759 - protein, 5 aa, Homo sapiens
ELREA

SEQ ID NO: 760 - protein, 6 aa, Homo sapiens
LREATS

SEQ ID NO: 761 - protein, 5 aa, Homo sapiens
LREAT

SEQ ID NO: 762 - DNA, 10 bp, Homo sapiens
ttaagagaag

SEQ ID NO: 763 - protein, 6 aa, Homo sapiens
ELREAT

SEQ ID NO: 764 - protein, 5 aa, Homo sapiens
KELRE

SEQ ID NO: 765 - DNA, 41 bp, Artificial Sequence
  source: /note="Description of Artificial Sequence: Synthetic oligonucleotide"
  modified_base (22)..(41): a, c, t, g, unknown or other
taatttctactaagtgtagatnnnnnnnnnnnnnnnnnnnn

SEQ ID NO: 766 - DNA, 56 bp, Artificial Sequence
  source: /note="Description of Artificial Sequence: Synthetic oligonucleotide"
  modified_base (37)..(56): a, c, t, g, unknown or other
gtttggtacctttattaatttctactaagtgtagatnnnnnnnnnnnnnnnnnnnn

What is claimed is:

1. A composition comprising:
a) a programmable nuclease having a turnover rate of at least 0.1 cleaved detector nucleic acid molecules per minute, and
b) a non-naturally occurring guide nucleic acid capable of hybridizing to a segment of a target nucleic acid, wherein the programmable nuclease comprises (i) three partial RuvC domains and (ii) an amino acid sequence at least 65% identical to SEQ ID NO: 11, wherein, if the non-naturally occurring guide nucleic acid hybridizes to the segment of the target nucleic acid, the programmable nuclease is activated to non-specifically cleave a detector nucleic acid, and wherein, if the turnover rate is quantified, it is quantified by determining the maximum trans cleavage velocity of the composition in a trans-cleavage reaction occurring at a temperature of from 25° C. to 45° C. divided by the amount of the composition in the trans-cleavage reaction.

2. The composition of claim 1, wherein the programmable nuclease recognizes a protospacer adjacent motif of YYN, wherein the Y is a C nucleotide or a T nucleotide, and wherein the N is any nucleotide.

3. The composition of claim 1, wherein the programmable nuclease recognizes a protospacer adjacent motif of YR, wherein the Y is a C nucleotide or a T nucleotide and wherein the R is an A nucleotide or a G nucleotide.

4. The composition of claim 1, wherein the programmable nuclease is a Type V programmable nuclease.

5. The composition of claim 1, wherein the programmable nuclease is a Cas12 nuclease.

6. The composition of claim 1, wherein the three partial RuvC domains comprise a RuvC-I subdomain, a RuvC-II subdomain, and a RuvC-III subdomain.

7. The composition of claim 1, wherein the programmable nuclease exhibits the turnover rate after heating the composition to a temperature of greater than 45° C. and restoring the temperature to from 25° C. to 45° C.

8. The composition of claim 1, wherein the programmable nuclease exhibits a higher turnover rate than a programmable nuclease having a sequence of SEQ ID NO: 1.

9. The composition of claim 1, further comprising the detector nucleic acid.

10. The composition of claim 9, wherein the detector nucleic acid comprises a detection moiety.

11. The composition of claim 10, wherein the detection moiety comprises a fluorescent moiety, a quenching moiety, or a combination thereof.

12. The composition of claim 9, wherein the detector nucleic acid comprises DNA, RNA, or a combination thereof.

13. The composition of claim 1, further comprising the target nucleic acid.

14. The composition of claim 13, wherein the target nucleic acid comprises a protospacer adjacent motif.

15. The composition of claim 14, wherein the protospacer adjacent motif is inserted into the target nucleic acid by amplifying the target nucleic acid.

16. The composition of claim 13, wherein the target nucleic acid comprises DNA.

17. The composition of claim 13, wherein the target nucleic acid comprises reverse transcribed cDNA.

18. The composition of claim 13, wherein the target nucleic acid comprises amplified DNA or reverse transcribed and amplified cDNA.

19. The composition of claim 1, wherein the programmable nuclease cleaves the detector nucleic acid molecules with an efficiency of at least 40%, wherein, if efficiency is measured, it is measured by a change in a signal produced by a population of detector nucleic acid molecules in a reaction performed at a temperature of about from 25° C. to 45° C., wherein the reaction comprises:
   at least 100 nM of the programmable nuclease,
   at least 125 nM of the guide nucleic acid, and
   at least 1 nM of the target nucleic acid.

20. The composition of claim 1, further comprising a buffer comprising a buffering agent, a salt, a crowding agent, a detergent, or any combination thereof.

21. The composition of claim 20, wherein the buffer comprises the salt at less than about 110 mM and wherein the buffer has a pH of from 7 to 8.

22. The composition of claim 20, wherein the buffer comprises the crowding agent or a competitor.

23. The composition of claim 1, wherein the programmable nuclease has a turnover rate of from 0.1 to 0.5 cleaved detector nucleic acid molecules per minute.

24. The composition of claim 1, wherein the programmable nuclease comprises an amino acid sequence at least 80% identical to SEQ ID NO: 11.

25. The composition of claim 1, wherein the programmable nuclease comprises an amino acid sequence at least 95% identical to SEQ ID NO: 11.

26. The composition of claim 1, wherein the programmable nuclease comprises an amino acid sequence of SEQ ID NO: 11.

* * * * *